US007968688B2

(12) United States Patent
Zauderer et al.

(10) Patent No.: US 7,968,688 B2
(45) Date of Patent: Jun. 28, 2011

(54) ANTIBODIES THAT BIND TO THE C35 POLYPEPTIDE

(75) Inventors: Maurice Zauderer, Pittsford, NY (US); Elizabeth E. Evans, Bloomfield, NY (US)

(73) Assignee: University of Rochester, Rochester, NY (US)

(*) Notice: Subject to any disclaimer, the term of this patent is extended or adjusted under 35 U.S.C. 154(b) by 88 days.

(21) Appl. No.: 12/350,937

(22) Filed: Jan. 8, 2009

(65) Prior Publication Data

US 2009/0297440 A1 Dec. 3, 2009

Related U.S. Application Data

(62) Division of application No. 10/457,829, filed on Jun. 10, 2003, now Pat. No. 7,563,882.

(60) Provisional application No. 60/386,738, filed on Jun. 10, 2002, provisional application No. 60/432,241, filed on Dec. 11, 2002, provisional application No. 60/464,650, filed on Apr. 23, 2003.

(51) Int. Cl.

| | |
|---|---|
| ***C12P 21/08*** | (2006.01) |
| ***C07K 16/00*** | (2006.01) |
| *A61K 39/395* | (2006.01) |
| *C12P 21/04* | (2006.01) |

(52) U.S. Cl. ............... 530/387.3; 424/133.1; 424/141.1; 424/155.1; 424/174.1; 435/69.6; 435/70.21; 530/388.1; 530/388.8; 530/388.85

(58) Field of Classification Search ........................ None
See application file for complete search history.

(56) References Cited

U.S. PATENT DOCUMENTS

| | | | |
|---|---|---|---|
| 4,444,887 | A | 4/1984 | Hoffmann |
| 4,474,893 | A | 10/1984 | Reading |
| 4,647,447 | A | 3/1987 | Gries et al. |
| 4,676,980 | A | 6/1987 | Segal et al. |
| 4,687,659 | A | 8/1987 | Quay |
| 4,714,681 | A | 12/1987 | Reading |
| 4,716,111 | A | 12/1987 | Osband et al. |
| 4,741,900 | A | 5/1988 | Alvarez et al. |
| 4,816,567 | A | 3/1989 | Cabilly et al. |
| 4,885,363 | A | 12/1989 | Tweedle et al. |
| 4,925,648 | A | 5/1990 | Hansen et al. |
| 4,946,778 | A | 8/1990 | Ladner et al. |
| 4,994,560 | A | 2/1991 | Kruper, Jr. et al. |
| 5,057,313 | A | 10/1991 | Shih et al. |
| 5,120,525 | A | 6/1992 | Goldenberg |
| 5,223,409 | A | 6/1993 | Ladner et al. |
| 5,225,539 | A | 7/1993 | Winter |
| 5,258,498 | A | 11/1993 | Huston et al. |
| 5,274,119 | A | 12/1993 | Frazier et al. |
| 5,314,995 | A | 5/1994 | Fell, Jr. et al. |
| 5,342,604 | A | 8/1994 | Wilson et al. |
| 5,367,080 | A | 11/1994 | Toner et al. |
| 5,403,484 | A | 4/1995 | Ladner et al. |
| 5,413,923 | A | 5/1995 | Kucherlapati et al. |
| 5,427,908 | A | 6/1995 | Dower et al. |
| 5,428,139 | A | 6/1995 | Kiefer et al. |
| 5,435,990 | A | 7/1995 | Cheng et al. |
| 5,441,050 | A | 8/1995 | Thurston et al. |
| 5,474,981 | A | 12/1995 | Leder et al. |
| 5,489,425 | A | 2/1996 | Kruper, Jr. et al. |
| 5,505,931 | A | 4/1996 | Pribish |
| 5,516,637 | A | 5/1996 | Huang et al. |
| 5,516,717 | A | 5/1996 | Hsu |
| 5,530,101 | A | 6/1996 | Queen et al. |
| 5,545,806 | A | 8/1996 | Lonberg et al. |
| 5,565,332 | A | 10/1996 | Hoogenboom et al. |
| 5,569,825 | A | 10/1996 | Lonberg et al. |
| 5,571,698 | A | 11/1996 | Ladner et al. |
| 5,573,920 | A | 11/1996 | Randle |
| 5,580,717 | A | 12/1996 | Dower et al. |
| 5,585,089 | A | 12/1996 | Queen et al. |
| 5,601,819 | A | 2/1997 | Wong et al. |
| 5,625,126 | A | 4/1997 | Lonberg et al. |
| 5,633,425 | A | 5/1997 | Lonberg et al. |
| 5,652,361 | A | 7/1997 | Simon et al. |
| 5,658,727 | A | 8/1997 | Barbas et al. |

(Continued)

FOREIGN PATENT DOCUMENTS

DE 196 39 601 A1 9/1997

(Continued)

OTHER PUBLICATIONS

William E. Paul, M.D. ed., Fundamental immunology, 3rd ed., p. 242, 292-295, 1993.*
Rudikoff et al. Proc. Natl. Acad. Sci. USA, 79(6):1979-1983, Mar. 1982.*
Colman P. M. Research in Immunology, 145:33-36, 1994.*
Bendig M. M. Methods: A Companion to Methods in Enzymology, 8:83-93, 1995.*
MacCallum et al. J. Mol. Biol., 262, 732-745, 1996.*
Casset et al. Biochemical and Biophysical Research Communications, 307:198-205, 2003.*

(Continued)

*Primary Examiner* — David J. Blanchard
(74) *Attorney, Agent, or Firm* — Sterne, Kessler, Goldstein & Fox P.L.L.C

(57) ABSTRACT

The present invention relates to a novel human gene that is differentially expressed in human carcinoma. More specifically, the present invention relates to a polynucleotide encoding a novel human polypeptide named C35 that is overexpressed in human breast and bladder carcinoma. This invention also relates to C35 polypeptide, in particular C35 peptide epitopes and C35 peptide epitope analogs, as well as vectors, host cells, antibodies directed to C35 polypeptides, and the recombinant methods for producing the same. The present invention further relates to diagnostic methods for detecting carcinomas, including human breast carcinomas. The present invention further relates to the formulation and use of the C35 gene and polypeptides, in particular C35 peptide epitopes and C35 peptide epitope analogs, in immunogenic compositions or vaccines, to induce antibody or cell-mediated immunity against target cells, such as tumor cells, that express the C35 gene. The invention further relates to screening methods for identifying agonists and antagonists of C35 activity.

21 Claims, 32 Drawing Sheets

U.S. PATENT DOCUMENTS

| | | | |
|---|---|---|---|
| 5,661,016 | A | 8/1997 | Lonberg et al. |
| 5,696,239 | A | 12/1997 | Wilson et al. |
| 5,698,426 | A | 12/1997 | Huse |
| 5,714,631 | A | 2/1998 | Wilson et al. |
| 5,733,743 | A | 3/1998 | Johnson et al. |
| 5,756,065 | A | 5/1998 | Wilson et al. |
| 5,766,883 | A | 6/1998 | Ballance et al. |
| 5,770,195 | A | 6/1998 | Hudziak et al. |
| 5,780,225 | A | 7/1998 | Wigler et al. |
| 5,807,715 | A | 9/1998 | Morrison et al. |
| 5,808,003 | A | 9/1998 | Subramanian et al. |
| 5,814,318 | A | 9/1998 | Lonberg et al. |
| 5,821,047 | A | 10/1998 | Garrard et al. |
| 5,837,242 | A | 11/1998 | Holliger et al. |
| 5,856,131 | A | 1/1999 | Hillman et al. |
| 5,876,969 | A | 3/1999 | Fleer et al. |
| 5,885,793 | A | 3/1999 | Griffiths et al. |
| 5,916,771 | A | 6/1999 | Hori et al. |
| 5,935,801 | A | 8/1999 | Schlossman et al. |
| 5,939,598 | A | 8/1999 | Kucherlapati et al. |
| 5,958,660 | A | 9/1999 | Taylor et al. |
| 5,969,108 | A | 10/1999 | McCafferty et al. |
| 5,972,622 | A | 10/1999 | Desjardins |
| 6,071,491 | A | 6/2000 | Epstein et al. |
| 6,489,101 | B1 | 12/2002 | Dillon et al. |
| 7,268,207 | B2 | 9/2007 | Zauderer et al. |
| 7,563,882 | B2 | 7/2009 | Zauderer et al. |
| 2002/0018749 | A1 | 2/2002 | Hudson et al. |
| 2002/0052308 | A1 | 5/2002 | Rosen et al. |
| 2002/0123057 | A1 | 9/2002 | Zauderer et al. |
| 2003/0148409 | A1 | 8/2003 | Rossi et al. |
| 2003/0166277 | A1 | 9/2003 | Zauderer et al. |
| 2005/0042218 | A1 | 2/2005 | Zauderer |
| 2005/0158323 | A1 | 7/2005 | Evans et al. |
| 2005/0196755 | A1 | 9/2005 | Zauderer et al. |
| 2006/0069159 | A1 | 3/2006 | Arterburn et al. |
| 2007/0081942 | A1 | 4/2007 | Zauderer et al. |
| 2008/0089886 | A1 | 4/2008 | Zauderer et al. |
| 2008/0305111 | A1 | 12/2008 | Evans et al. |
| 2009/0081210 | A1 | 3/2009 | Evans et al. |
| 2009/0305350 | A1 | 12/2009 | Zauderer et al. |
| 2009/0312263 | A1 | 12/2009 | Zauderer et al. |

FOREIGN PATENT DOCUMENTS

| | | | |
|---|---|---|---|
| EP | 0 171 496 | B1 | 2/1986 |
| EP | 0 239 400 | A2 | 9/1987 |
| EP | 0 396 387 | A2 | 11/1990 |
| EP | 0 439 095 | B1 | 7/1991 |
| EP | 0 519 596 | B1 | 12/1992 |
| EP | 0 592 106 | B1 | 4/1994 |
| EP | 1 033 401 | A2 | 9/2000 |
| WO | WO 86/01533 | A1 | 3/1986 |
| WO | WO 87/02671 | A1 | 5/1987 |
| WO | WO 90/02809 | A1 | 3/1990 |
| WO | WO 91/09967 | A1 | 7/1991 |
| WO | WO 91/10737 | A1 | 7/1991 |
| WO | WO 91/10741 | A1 | 7/1991 |
| WO | WO 91/14438 | A1 | 10/1991 |
| WO | WO 91/17271 | A1 | 11/1991 |
| WO | WO 92/01047 | A1 | 1/1992 |
| WO | WO 92/06204 | A1 | 4/1992 |
| WO | WO 92/08495 | A1 | 5/1992 |
| WO | WO 92/08802 | A1 | 5/1992 |
| WO | WO 92/11018 | A1 | 7/1992 |
| WO | WO 92/22324 | A1 | 12/1992 |
| WO | WO 93/11236 | A1 | 6/1993 |
| WO | WO 93/17715 | A1 | 9/1993 |
| WO | WO 93/21232 | A1 | 10/1993 |
| WO | WO 94/03205 | A1 | 2/1994 |
| WO | WO 94/20127 | A1 | 9/1994 |
| WO | WO 95/15982 | A2 | 6/1995 |
| WO | WO 95/20401 | A1 | 8/1995 |
| WO | WO 96/34096 | A1 | 10/1996 |
| WO | WO 96/39515 | A1 | 12/1996 |
| WO | WO 97/13844 | A1 | 4/1997 |
| WO | WO 98/02543 | A1 | 1/1998 |
| WO | WO 98/07832 | A1 | 2/1998 |
| WO | WO 98/16654 | A1 | 4/1998 |
| WO | WO 98/24893 | A2 | 6/1998 |
| WO | WO 98/46645 | A2 | 10/1998 |
| WO | WO 99/33869 | A2 | 7/1999 |
| WO | WO 99/37775 | A2 | 7/1999 |
| WO | WO 00/55173 | A1 | 9/2000 |
| WO | WO 00/55350 | A1 | 9/2000 |
| WO | WO 01/40269 | A2 | 6/2001 |
| WO | WO 01/74859 | A3 | 10/2001 |
| WO | WO 01/78768 | A2 | 10/2001 |
| WO | WO 02/00677 | A1 | 1/2002 |

OTHER PUBLICATIONS

Ames, R.S., et al., "Conversion of murine Fabs isolated from a combinatorial phage display library to full length immunoglobulins," *J. Immunol. Meth.* 184:177-186, Elsevier Science B.V. (1995).

Anderson, C.J., et al., "Preparation, Biodistribution and Dosimetry of Copper-64-Labeled Anti-Colorectal Carcinoma Monoclonal Antibody Fragments 1A3-F(ab')2," *J. Nucl. Med.* 36:850-858, Society of Nuclear Medicine (1995).

Arnon, R., et al., "Monoclonal Antibodies for Immunotargeting of Drugs in Cancer Therapy," in: *Monoclonal Antibodies & Cancer Therapy,* Reisfeld, R.A. and Sell, S., eds., Alan R. Liss, Inc., New York, NY, pp. 243-256 (1985).

Better, M., et al., "*Escherichia coli* Secretion of an Active Chimeric Antibody Fragment," *Science* 240:1041-1043, American Association for the Advancement of Science (1988).

Bird, R.E., et al., "Single-Chain Antigen-Binding Proteins," *Science* 242:423-426, American Association for the Advancement of Science (1988).

Boulianne, G.L., et al., "Production of functional chimeric mouse/human antibody," *Nature* 312:643-646, Macmillan Journals Ltd. (1984).

Brinkmann, U., et al., "Phage display of disulfide-stabilized Fv fragments," *J. Immunol. Meth.* 182:41-50, Elsevier Science B.V. (1995).

Burchiel, S.W., et al., "Immunopharmacokinetics of Radiolabeled Antibodies and Their Fragments," in: *Tumor Imaging, The Radioimmunochemical Detection of Cancer,* Burchiel, S.W., et al., eds., Masson Publishing USA, Inc., New York, NY, pp. 125-139 (1982).

Burke, P.A.,. et al., "Combined Modality Radioimmunotherapy," *Suppl. Cancer 94*1320-1331, American Cancer Society (Feb. 2002).

Burton, D.R. and Barbas III, C.F., "Human Antibodies from Combinatorial Libraries," in: *Advances in Immunology,* Dixon, F.J., et al., eds., Academic Press, San Diego, CA, pp. 191-280 (1994).

Butler, J.E., "The Amplified ELISA: Principles of and Applications for the Comparative Quantitation of Class and Subclass Antibodies and the Distribution of Antibodies and Antigens in Biochemical Separates," *Meth. Enzymol. 73*:482-523, Academic Press, Inc. (1981).

Casset, F. et al., "A peptide mimetic of an anti-CD4 monoclonal antibody by rational design," *Biochem. Biophys. Res. Commun. 307*(1): 198-205, Academic Press, United States (Jul. 2003).

Chen, Y., et al., "Selection and analysis of an optimized anti-VEGF antibody: crystal structure of an affinity-matured Fab in complex with antigen," *J. Mol. Biol. 293*(4): 865-81, Academic Press, England (Nov. 1999).

Chothia, C., et al., "Structural Determinants in the Sequences of Immunoglobulin Variable Domain," *J. Mol. Biol. 278*:457-479, Academic Press Ltd. (1998).

Clarke, K., et al., "Therapeutic Efficacy of Anti-Lewisy Humanized 3S193 radioimmunotherapy in a Breast Cancer Model: Enhanced Activity When Combined with Taxol Chemotherapy," *Clin. Cancer Res. 6*:3621-3628, American Association for Cancer Research (2000).

Co, M.S., et al., "Humanized antibodies for antiviral therapy," *Proc. Natl. Acad. Sci. USA 88*:2869-2873, National Academy of Sciences (1991).

Cockett, M.I., et al., "High Level Expression of Tissue Inhibitor of Metalloproteinases in Chinese Hamster Ovary Cells Using Glutamine Synthetase Gene Amplification," *Bio/Technol. 8*:662-667, Nature Publishing Co. (1990).

Coldman, A.J. and Goldie, J.I., "A Model for the Resistance of Tumor Cells to Cancer Chemotherapeutic Agents," *Math. Biosci. 65*:291-307, Elsevier Science Publishing Co., Inc. (1983).

Comparison of C35 DNA sequence with actual sequences for deposited clones corresponding to W57569 (Document AT12) and AA971857 (Document AT19), prepared by inventors of parent application, Zauderer et al.
De Pascalis, R., et al., "Grafting of "abbreviated" complementarity-determining regions containing specificity-determining residues essential for ligand contact to engineer a less immunogenic humanized monoclonal antibody," *J. Immunol. 169*(6): 3076-84, American Association of Immunologists, United States (Sep. 2002).
Denardo, S.J., et al., "Synergistic Therapy of Breast Cancer with Y-90-Chimeric L6 and Paclitaxel in the Xenografted Mouse Model: Development of a Clinical Protocol," *Anticancer Res. 18*:4011-4018, J.G. Delinassios, Anticancer Research (1998).
Deshpande, S.V., et al., "Yttrium-90-Labeled Monoclonal Antibody for Therapy: Labeling by a New Macrocyclic Bifunctional Chelating Agent," *J. Nucl. Med. 31*:473-479, Society of Nuclear Medicine (1990).
Desrues, B., et al., "Monclonal antibody Po66 uptake by human lung tumours implanted in nude mice: effect of co-administration with doxorubicin," *Brit. J. Cancer 72*:1076-1082, Stockton Press (1995).
Dialog File 351, Accession No. 11458822, WPI English language abstract of DE 196 36 601 (1997) (listed on accompanying PTO/SB/08A as document FP31).
Dialog File 351, Accession No. 11693681, WPI English language abstract of WO 98/02543 (1998) (listed on accompanying PTO/SB/08A as document FP32).
EMBL Entry, Accession No. AW327450, from NIH-MGC, Entry date 2000.
EMBL-EBI database, Accession No. AAG03153, Dumas Milne Edwards, J., et al., Entry date 2000.
Evans, E.E., et al., "C35 is a novel immunotherapy target expressed in human breast and bladder carcinoma," *Breast Cancer Res. Treat. (Abs.)—Poster Session IV*:311, Kluwer Academic Publishers (2001).
Fell, H.P., et al., "Genetic Construction and Characterization of a Fusion Protein Consisting of a Chimeric F(ab') with Specificity for Carcinomas and Human IL-2," *J. Immunol. 146*:2446-2452, The American Association of Immunologists (1991).
GenCore database, amino acid alignment between Applicants' SEQ ID No: 2 and patent publication US20020052308A1, sequence 966 (2004).
GenCore database, amino acid comparison between Applicants' SEQ ID: 2 and sequence 3 of U.S. Patent No. 5,856,131, Jan. 5, 1999.
Gillies, S.D., et al., "High-level expression of chimeric antibodies using adapted cDNA variable region cassettes," *J. Immunol. Meth.* 125:191-202, Elsevier Science Publishers B.V. (1989).
Glaser, S.M., et al., "Dissection of the combining site in a humanized anti-Tac antibody," *J. Immunol. 149*(8): 2607-14, American Association of Immunologists, United States (Oct. 1992).
Hellström, K.E., et al., "Antibodies for Drug Delivery," in: *Controlled Drug Delivery*, Robinson, J.R. and Lee, V.H., eds., Marcel Dekker, Inc., New York, NY, pp. 623-653 (1987).
Holm, P., et al., "Functional mapping and single chain construction of the anti-cytokeratin 8 monoclonal antibody TS1," *Mol. Immunol.* 44(6): 1075-84, Pergamon Press, England (Feb. 2007; Epub Sep. 2006).
Hudson, P.J. and Souriau, C., "Engineered antibodies," *Nat. Med. 9*:129-134, Nature Publishing Company (Jan. 2003).
Huston, J.S., et al., "Protein engineering of antibody binding sites: Recovery of specific activity in an anti-digoxin single-chain Fv analogue produced in *Escherichia coli*," *Proc. Natl. Acad. Sci. USA 85*:5879-5883, National Academy of Sciences (1988).
Huston, J.S., et al., "Protein Engineering of Single-Chain Fv Analogs and fusion Proteins," *Meth. Enzymol. 203*:46-88, Academic Press, Inc. (1991).
Iwahashi, M., et al., "CDR substitutions of a humanized monoclonal antibody (CC49): contributions of individual CDRs to antigen binding and immunogenicity," *Mol. Immunol. 36*(15-16): 1079-91, Pergamon Press, England (Oct.-Nov. 1999).
Jespers, L.S., et al., "Guiding the Selection of Human Antibodies from Phage Display Repertoires to a Single Epitope of an Antigen," *Bio/Technol. 12*:899-903, Nature Publishing Company (1994).
Kettleborough, et al., "Isolation of tumor cell-specific single-chain Fv from immunized mice using phage-antibody libraries and the re-construction of whole antibodies from these antibody fragments," *Eur. J. Immunol. 24*:952-958, VCH Verlasgesellschaft mbH (1994).
Kraeber-Bodéré, et al., "Enhanced Antitumor Activity of Combined Pretargeted Radioimmunotherapy and Paclitaxel in Medullary Thyroid Cancer Xenograft," *Molec. Cancer Ther. 1*:267-274, American Association for Cancer Research, Inc. (Feb. 2002).
Lazar, E., et al., "Transforming Growth Factor $\alpha$: Mutation of Aspartic Acid 47 and Leucine 48 Results in Different Biological Activities," *Mol. Cell, Biol. 8*:1247-1252, American Society for Microbiology (1988).
Lonberg, N. and Huszar, D., "Human Antibodies from Transgenic Mice," *Intern. Rev. Immunol. 13*:65-93, Harwood Academic Publishers GmbH (1995).
MacCallum, R.M., et al., "Antibody-antigen interactions: contact analysis and binding site topography," *J. Mol. Biol. 262*(5): 732-45, Academic Press, England (Oct. 1996 ).
Moi, M.K., et al., "Stable bifunctional chelates of metals used in radiotherapy," *Cancer Res. 50*:789s-793s, American Association for Cancer Research (1990).
Montano, R.F. & Morrison, S.L., "Influence of the isotype ofthe lightchain on the properties of IgG," *J. Immunol. 168*(1): 224-31, American Association of Immunologists, United States (Jan. 2002).
Morrison, S.L., "Transfectomas Provide Novel Chimeric Antibodies," *Science 229*:1202-1207, American Association for the Advancement of Science (1985).
Morrison, S.L., et al., "Chimeric human antibody molecules: Mouse antigen-binding domains with human constant region domains," *Proc. Natl. Acad. Sci. USA 81*:6851-6855, National Academy of Sciences (1984).
Mueller, B.M., et al., "Serum half-life and tumor localization of a chimeric antibody deleted of the CH2 domain and directed against the disialoganglioside GD2," *Proc. Natl. Acad. Sci. USA 87*:5702-5705, National Academy of Sciences (1990).
Mullinax, R.L., et al., "Expression of a Heterodimeric Fab Antibody Protein in One Cloning Step," *Bio Techniques 12*:864-869, Eaton Publishing Company (1992).
NCBI Entrez, GenBank Report, Accession No. AA026773, Hillier, L., et al., Entry date 1996.
NCBI Entrez, GenBank Report, Accession No. AA026774, Hillier, L., et al., Entry date1996.
NCBI Entrez, GenBank Report, Accession No. AA037285, Hillier, L., et al., Entry date1996.
NCBI Entrez, GenBank Report, Accession No. AA284919, Hillier, L., et al., Entry date1997.
NCBI Entrez, GenBank Report, Accession No. AA285089, Hillier, L., et al., Entry date1997.
NCBI Entrez, GenBank Report, Accession No. AA308370, Adams, M.D., et al., Entry date 1997.
NCBI Entrez, GenBank Report, Accession No. AA313422, Adams, M.D., et al., Entry date1997.
NCBI Entrez, GenBank Report, Accession No. AA337071, Adams, M.D., et al., Entry date 1997.
NCBI Entrez, GenBank Report, Accession No. AA375119, Adams, M.D., et al., Entry date1997.
NCBI Entrez, GenBank Report, Accession No. AA375286, Adams, M.D., et al., Entry date 1997.
NCBI Entrez, GenBank Report, Accession No. AA393628, Hillier, L., et al., Entry date 1997.
NCBI Entrez, GenBank Report, Accession No. AA502178, from NCI-CGAP, Entry date 1997.
NCBI Entrez, GenBank Report, Accession No. AA568537, from NCI-CGAP, Entry date 1997.
NCBI Entrez, GenBank Report, Accession No. AA704668, Hillier, L., et al., Entry date 1997.
NCBI Entrez, GenBank Report, Accession No. AA707623, from NCI-CGAP, Entry date 1997.
NCBI Entrez, GenBank Report, Accession No. AA813244, from NCI-CGAP, Entry date 1998.
NCBI Entrez, GenBank Report, Accession No. AA830592, from NCI-CGAP, Entry date 1998.
NCBI Entrez, GenBank Report, Accession No. AA872671, from NCI-CGAP, Entry date 1998.

NCBI Entrez, GenBank Report, Accession No. AA911823, from NCI-CGAP, Entry date 1998.
NCBI Entrez, GenBank Report, Accession No. AA935328, from NCI-CGAP, Entry date 1998.
NCBI Entrez, GenBank Report, Accession No. AA971638, from NCI-CGAP, Entry date 1998.
NCBI Entrez, GenBank Report, Accession No. AA971857, from NCI-CGAP, Entry date1998.
NCBI Entrez, GenBank Report, Accession No. AI025384, from NCI-CGAP, Entry date 1998.
NCBI Entrez, GenBank Report, Accession No. AI041967, from NCI-CGAP, Entry date 1998.
NCBI Entrez, GenBank Report, Accession No. AI051009, from NCI-CGAP, Entry date 1998.
NCBI Entrez, GenBank Report, Accession No. AI083674, from NCI-CGAP, Entry date 1998.
NCBI Entrez, GenBank Report, Accession No. AI199227, from NCI/NINDS-CGAP, Entry date 1998.
NCBI Entrez, GenBank Report, Accession No. AI285284, from NCI-CGAP, Entry date 1998.
NCBI Entrez, GenBank Report, Accession No. AI288765, from NCI-CGAP, Entry date 1998.
NCBI Entrez, GenBank Report, Accession No. AI336555, from NCI-CGAP, Entry date 1998.
NCBI Entrez, GenBank Report, Accession No. AI360416, from NCI/NINDS-CGAP, Entry date 1999.
NCBI Entrez, GenBank Report, Accession No. AI362693, from NCI/NINDS-CGAP, Entry date 1999.
NCBI Entrez, GenBank Report, Accession No. AI439771, from NCI-CGAP, Entry date 1999.
NCBI Entrez, GenBank Report, Accession No. AI499727, from NCI/NINDS-CGAP, Entry date 1999.
NCBI Entrez, GenBank Report, Accession No. AI525314, Huang, G.M., et al., Entry date 1999.
NCBI Entrez, GenBank Report, Accession No. AI672936, from NCI-CGAP, Entry date 1999.
NCBI Entrez, GenBank Report, Accession No. AI800991, from NCI-CGAP, Entry date 1999.
NCBI Entrez, GenBank Report, Accession No. AI909652, Dias Neto, E., et al., Entry date 1999.
NCBI Entrez, GenBank Report, Accession No. AI914716, from NCI-CGAP, Entry date 1999.
NCBI Entrez, GenBank Report, Accession No. AI934846, from NCI/NINDS-CGAP, Entry date 1999.
NCBI Entrez, GenBank Report, Accession No. AI937133, from NCI/NINDS-CGAP, Entry date 1999.
NCBI Entrez, GenBank Report, Accession No. AW006797, from NCI-CGAP, Entry date 1999.
NCBI Entrez, GenBank Report, Accession No. AW327450, from NIH-MGC, Entry date 1999.
NCBI Entrez, GenBank Report, Accession No. AW406075, from NIH-MGC, Entry date 2000.
NCBI Entrez, GenBank Report, Accession No. AW406223, from NIH-MGC, Entry date 2000.
NCBI Entrez, GenBank Report, Accession No. H12779, Hillier, L., et al., Entry date 1995.
NCBI Entrez, GenBank Report, Accession No. H12836, Hillier, L., et al., Entry date 1995.
NCBI Entrez, GenBank Report, Accession No. H56522, Hillier, L., et al., Entry date 1995.
NCBI Entrez, GenBank Report, Accession No. H56704, Hillier, L., et al., Entry date 1995.
NCBI Entrez, GenBank Report, Accession No. H94832, Hillier, L., et al., Entry date 1995.
NCBI Entrez, GenBank Report, Accession No. H95363, Hillier, L., et al., Entry date 1995.
NCBI Entrez, GenBank Report, Accession No. H96055, Hillier, L., et al., Entry date 1995.
NCBI Entrez, GenBank Report, Accession No. H96058, Hillier, L., et al., Entry date 1995.
NCBI Entrez, GenBank Report, Accession No. H96418, Hillier, L., et al., Entry date 1995.
NCBI Entrez, GenBank Report, Accession No. H96422, Hillier, L., et al., Entry date 1995.
NCBI Entrez, GenBank Report, Accession No. N26715, Hillier, L., et al., Entry date 1995.
NCBI Entrez, GenBank Report, Accession No. N27088, Hillier, L., et al., Entry date 1995.
NCBI Entrez, GenBank Report, Accession No. N31910, Hillier, L., et al., Entry date1996.
NCBI Entrez, GenBank Report, Accession No. N32532, Hillier, L., et al., Entry date 1996.
NCBI Entrez, GenBank Report, Accession No. N34596, Hillier, L., et al., Entry date1996.
NCBI Entrez, GenBank Report, Accession No. N42693, Hillier, L., et al., Entry date 1996.
NCBI Entrez, GenBank Report, Accession No. N42748, Hillier, L., et al., Entry date1996.
NCBI Entrez, GenBank Report, Accession No. R12836, Hillier, L., et al., Entry date 1995.
NCBI Entrez, GenBank Report, Accession No. R22331, Hillier, L., et al., Entry date 1995.
NCBI Entrez, GenBank Report, Accession No. R22332, Hillier, L., et al., Entry date1995.
NCBI Entrez, GenBank Report, Accession No. R22401, Hillier, L., et al., Entry date 1995.
NCBI Entrez, GenBank Report, Accession No. R23139, Hillier, L., et al., Entry date1995.
Ncbi Entrez, GenBank Report, Accession No. R23369, Hillier, L., et al., Entry date 1995.
NCBI Entrez, GenBank Report, Accession No. R32153, Hillier, L., et al., Entry date 1995.
NCBI Entrez, GenBank Report, Accession No. R32154, Hillier, L., et al., Entry date1995.
NCBI Entrez, GenBank Report, Accession No. R63575, Hillier, L., et al., Entry date1995.
NCBI Entrez, GenBank Report, Accession No. R68799, Hillier, L., et al., Entry date 1995.
NCBI Entrez, GenBank Report, Accession No. R68901, Hillier, L., et al., Entry date 1995.
NCBI Entrez, GenBank Report, Accession No. T84927, Hillier, L., et al., Entry date 1995.
NCBI Entrez, GenBank Report, Accession No. T92052, Hillier, L., et al., Entry date1995.
NCBI Entrez, GenBank Report, Accession No. W32121, Hillier, L., et al., Entry date1996.
NCBI Entrez, GenBank Report, Accession No. W37432, Hillier, L., et al., Entry date 1996.
NCBI Entrez, GenBank Report, Accession No. W44577, Hillier, L., et al., Entry date1996.
NCBI Entrez, GenBank Report, Accession No. W51792, Hillier, L., et al., Entry date 1996.
NCBI Entrez, GenBank Report, Accession No. W57569, Hillier, L., et al., Entry date 1996.
NCBI Entrez, GenBank Report, Accession No. W61294 Hillier, L., et al., Entry date1996.
NCBI Entrez, GenBank Report, Accession No. W65390, Hillier, L., et al., Entry date 1996.
Neuberger, M.S., et al., "A hapten-specific chimaeric IgE antibody with human physiological effector function," *Nature 314*:268-270, Macmillan Journals Ltd. (1985).
Neuberger, M.S., et al., "Recombinant antibodies possessing novel effector functions," *Nature 312*:604-608, Macmillan Journals Ltd. (1984).
Norton, L. and Simon, R., "Tumor Size, Sensitivity to Therapy, and Design of Treatment Schedules," *Cancer Treatment Rep. 61*:1307-1317, U.S. National Cancer Institute (1977).
O'Donnell, R.T., et al., "Combined Modality Radioimmunotherapy for Human Prostate Cancer Xenografts with Taxanes and 90Yttrium-DOtA-Peptide-ChL6," *Prostate 50*:27-37, Wiley-Liss, Inc. (Jan. 2002).
Oi, V.T. and Morrison, S.L., "Chimeric Antibodies," *Bio Techniques 4*:214-221, Eaton Publishing Company (1986).
Order, S.E., "Analysis, Results, and Future Prospective of the Therapeutic Use of Radiolabeled Antibody in Cancer Therapy," in:

*Monoclonal Antibodies for Cancer Detection and Therapy,* Baldwin, R.W. and Byers, V.S., eds., Academic Press, London, UK, pp. 303-316 (1985).
Padlan, E.A., "A Possible Procedure for Reducing the Immunogenicity of Antibody variable Domains While Preserving Their Ligand-Binding Properties," *Molec. Immunol. 28*:489-498, Pergamon Press (1991).
Persic, L., et al., "An integrated vector system for the eukaryotic expression of antibodies or their fragments after selection from phage display libraries," *Gene 187*:9-18, Elsevier Science B.V. (1997).
Riechmann, L., et al., "Reshaping human antibodies for therapy," *Nature 332*:323-327, Macmillan Journals Ltd. (1988).
Roguska, M.A., et al., "Humanization of murine monoclonal antibodies through variable domain resurfacing," *Proc. Natl. Acad. Sci. USA 91*:969-973, National Academy of Sciences (1994).
Roitt, I., et al. (Eds), "Immunology," 6th Edition, pp. 74-78, Mosby, New York (2001).
Rudikoff, S., et al., "Single amino acid substitutio altering antgen-binding specificity," *Proc. Natl. Acad. Sci. USA. 79*(6): 1979-83, National Academy of Sciences, United States (Mar. 1982).
Sahasrabudhe, D.M., et al., "Shared T Cell-Defined Antigens on Independently Derived Tumors," *J. lmmunol.* 151:6302-6310, The American Association of Immunologists (1993).
Sahasrabudhe, D.M., et al., "Shared T Cell-Defined Antigens on Independently Derived Tumors," *J. Immunol. 151*:6302-6310, The American Association of Immunologists (1993).
Saji, H., "Targeted Delivery of Radiolabeled Imaging and Therapeutic Agents: Bifunctional Radiopharmaceuticals," *Crit. Rev. Ther. Drug Carr. Syst. 16*:209-244, Begell House, Inc. (1999).
Shu, L., et al., "Secretion of a single-gene-encoded immunoglobulin from myeloma cells," *Proc. Natl. Acad. Sci. USA 90*:7995-7999, National Academy of Science (1993).
Skerra, A. and Plückthun, A., "Assembly of a Functional Immunoglobulin Fv Fragment in *Escherichia coil,*" *Science 240*:1038-1041, American Association for the Advancement of Science (1988).
Skolnick, J. & Fetrow, J.S., "From genes to protein structure and function: novel applications of computational approaches in the genomic era," Trends Biotechnol. 18(1): 34-9, Elsevier Science Publishers, England (Jan. 2000).
Slavin-Chiorini, D.C., et al., "Biologic Properties of a CH2 Domain-Deleted Recombinant Immunoglobulin," *Int. J. Cancer 53*:97-103, Wiley-Liss, Inc. (1993).
Srivastava, S.C. and Mease, R.C., "Progress in Research on Ligands, Nucleotides and Techniques for Labeling Monoclonal Antibodies," *Nucl. Med. Biol. 18*:589-603, Pergamon Press (1991).
Stein, R., et al., "Combining Radioimmunotherapy and Chemotherapy for Treatment of Medullary Thyroid Carcinoma," *Cancer 94*:51-61, American Cancer Society (Jan. 2002).
Studnicka, G.M., et al., "Human-engineered monoclonal antibodies retain full specific binding activity by preserving non-CDR complementarity-modulating residues," *Prot. Eng. 7*:805-814, Oxford University Press (1994).
Subramanian, R. and Meares, C.F., "9. Bifunctional chelating agents for radiometal-labeled monoclonal antibodies," in: *Cancer Imaging with Radiolabeled Antibodies,* Goldenberg, D.M., ed., Kluwer Academic Publishers, Boston, MA, pp. 183-199 (1990).
Takeda, S.-I., et al., "Construction of chimeric processed immunoglobulin genes containing mouse variable and human constant region sequences," *Nature 314*:452-454, Macmillan Journals Ltd. (1985).
Tamura, M., et al., "Structural correlates of an anticarcinoma antibody: identification of specificity-determining residues (SDRs) and development of a minimally immunogenic antibody variant by retention of SDRs only," *J. Immunol. 164*(3): 1432-41, American Association of Immunologists, United States (Feb. 2000).
Thorpe, P.E. and Ross, W.C.J., "The Preparation and Cytotoxic Properties of Antibody-Toxin Conjugates," *Immunol. Rev. 62*:119-158, Munksgaard (1982).
Thorpe, P.E., "Antibody Carriers of Cytotoxic Agents in Cancer Therapy: A Review," in: *Monoclonal Antibodies '84: Biological and Clinical Applications,* Pinchera, A., et al., eds., Editrice Kurtis, Milan, IT, pp. 475-506 (1985).
Tibor, A., et al, "Molecular characterization, occurrence, and immunogenicity in infected sheep and cattle of two minor outer membrane proteins of Brucells abortus," *Infect. Immun. 64*(1): 100-7, American Society for Microbiology, United States (Jan. 1996).
Tutt, A., et al., "Trispecific F(ab')3 Derivatives that Use Cooperative Signaling Via the TCR/CD3 Complex and CD2 to Activate and Redirect Resting Cytotoxic T Cells," *J. Immunol. 147*:60-69, The American Association of Immunologists (1991).
Vajdos, F.F., et al., "Comprehensive functional maps of the antigen-binding site of an X anti-ErbB2 antibody obtained with shotgun scanning mutagenesis," *J. Mol. Biol. 320*(2): 415-28, Academic Press, England (Jul. 2002).
Villena-Heinsen, C., et al., "Human ovarian cancer xenografts in nude mice: chemotherapy trials with paclitaxel, cisplatin, vinorelbine and titanocene dichloride," *Anti-Cancer Drugs 9*:557-563, Lippincott-Rave Publishers (1998).
Ward, E.S., et al., "Binding activities of a repertoire of single immunoglobulin variable domains secreted from *Escherichia coli,*" *Nature 341*:544-546, Macmillan Journals Ltd. (1989).
Wu, H., et al., "Humanization of a murine monoclonal antibody by simultaneous optimization of framework and CDR residues," *J. Mol. Biol. 294*(1): 151-62, Academic Press, England (Nov. 1999).
International Search Report for International Application No. PCT/US04/40573, mailed Sep. 6, 2005.
International Search Report for International Application No. PCT/US07/014712, mailed Sep. 4, 2008.
International Search Report for International Application No. PCT/US08/13998, mailed Feb. 23, 2009.
U.S. Appl. No. 11/892,018, inventors Evans et al., filed Aug. 17, 2007 (not published; Abandoned).
U.S. Appl. No. 12/810,743, inventors Zauderer et al., I.A. filed Dec. 23, 2008 (not yet published).
Office Action for U.S. Appl. No. 12/350,944, Zauderer, M., et al., filed Jan. 8, 2009, mailed on Jun. 17, 2010.

* cited by examiner

Clone C35

DNA Coding Sequence gcc gcg ATG AGC GGG GAG CCG GGG CAG ACG TCC GTA
GCG CCC CCT CCC GAG GAG GTC GAG CCG GGC AGT
GGG GTC CGC ATC GTG GTG GAG TAC TGT GAA CCC
TGC GGC TTC GAG GCG ACC TAC CTG GAG CTG GCC
AGT GCT GTG AAG GAG CAG TAT CCG GGC ATC GAG
ATC GAG TCG CGC CTC GGG GGC ACA GGT GCC TTT
GAG ATA GAG ATA AAT GGA CAG CTG GTG TTC TCC
AAG CTG GAG AAT GGG GGC TTT CCC TAT GAG AAA
GAT CTC ATT GAG GCC ATC CGA AGA GCC AGT AAT
GGA GAA ACC CTA GAA AAG ATC ACC AAC AGC CGT
CCT CCC TGC GTC ATC CTG TGA

FIG.1A

Protein Sequence

MSGEPGQTSVAPPPEEVEPGSGVRIVVEYCEPCGFEATYLEL
ASAVKEQYPGIEIESRLGGTGAFEIEINGQLVFSKLENGGFPY
EKDLIEAIRRASNGETLEKITNSRPPCVIL*

FIG.1B

C35 isExpressed at High Levels in Breast Tumors but Not Normal Tissues

C35 isExpressed at High Levels inBreast Tumors but Not Normal Tissues

C35 isExpressed at High Levels in Breast Tumors but Not Normal Tissues

| TARGET | PERCENT SPECIFIC LYSIS EFFECTOR : TARGET 10:1 | 2:1 |
|---|---|---|
| BCA 34 | 68.4 | 54.8 |
| BCA 39 | 36.6 | 23.4 |
| B/C.N | 0.2 | 0.3 |
| B/C.N + vF5.8 | 47.5 | 34.6 |
| B/C.N + vH2.16 | 67.8 | 56.2 |
| B/C.N + VACCINIA VECTOR | 0 | 0.2 |

| Amino Acid Position | 45 | 46 | 47 | 48 | 49 | 50 | 51 | 52 | 53 | 54 | 55 | 56 |
|---|---|---|---|---|---|---|---|---|---|---|---|---|
| Sequence | A | F | L | G | Y | K | A | G | M | T | H | I |
| Nucleotide | GCC | TTT | CTG | GGT | TAC | AAG | GCT | GGC | ATG | ACC | CAC | ATC |

| Amino Acid Position | 45 | 46 | 47 | 48 | 49 | 50 | 51 | 52 | 53 | 54 | 55 | 56 |
|---|---|---|---|---|---|---|---|---|---|---|---|---|
| Sequence | A | F | L | G | Y | K | A | G | M | I | H | I |
| Nucleotide | --- | --- | --- | --- | --- | --- | --- | --- | --- | -T- | --- | --- |

FIG.6B

| TARGET | PERCENT SPECIFIC LYSIS EFFECTOR : TARGET 10:1 | 2:1 |
|---|---|---|
| BCA 34 | 62.4 | 32.1 |
| BCA 39 | 49.7 | 23.6 |
| B/C.N | 3.3 | 0.2 |
| B/C.N + L3 PEPTIDE 48-56 (I54) | 46.0 | 16.1 |
| B/C.N + L3 PEPTIDE 48-56 (T54) | 2.0 | 0 |
| B/C.N + L3 PEPTIDE 45-54 (I54) | 0 | 0 |

FIG.7A

PERCENT SPECIFIC LYSIS
IMMUNOGEN

| TARGET | vH2.16 40:1 | vH2.16 10:1 | v7.5/tk 40:1 | v7.5/tk 10:1 |
|---|---|---|---|---|
| BCA 34 | 33.6 | 12.9 | 5.7 | 4.0 |
| BCA 39 | 22.1 | 9.0 | 5.3 | 3.1 |
| B/C.N + L3 48-56 (I54) | 48.2 | 20.2 | 3.9 | 1.5 |
| B/C.N + L3 48-56 (T54) | 6.4 | 1.4 | 1.8 | 2.9 |
| B/C.N | 7.1 | 5.7 | 6.1 | 2.8 |
| YAC | 1.2 | 2.5 | 0 | 1.8 |

FIG.9A

```
gcccgagcggagccggccgcg ATG AGC GGG GAG CCG GGG CAG ACG TCC
                      M   S   G   E   P   G   Q   T   S
GTA GCG CCC CCT CCC GAG GAG GTC GAG CCG GGC AGT GGG GTC CGC
V   A   P   P   P   E   E   V   E   P   G   S   G   V   R

ATC GTG GTG GAG TAC TGT GAA CCC TGC GGC TTC GAG GCG ACC TAC
I   V   V   E   Y   C   E   P   C   G   F   E   A   T   Y

CTG GAG CTG GCC AGT GCT GTG AAG GAG CAG TAT CCG GGC ATC GAG
L   E   L   A   S   A   V   K   E   Q   Y   P   G   I   E

ATC GAG TCG CGC CTC GGG GGC ACA GGT GCC TTT GAG ATA GAG ATA
I   E   S   R   L   G   G   T   G   A   F   E   I   E   I

AAT GGA CAG CTG GTG TTC TCC AAG CTG GAG AAT GGG GGC TTT CCC
N   G   Q   L   V   F   S   K   L   E   N   G   G   F   P

TAT GAG AAA GAT CTC ATT GAG GCC ATC CGA AGA GCC AGT AAT GGA
Y   E   K   D   L   I   E   A   I   R   R   A   S   N   G

GAA ACC CTA GAA AAG ATC ACC AAC AGC CGT CCT CCC TGC GTC ATC
E   T   L   E   K   I   T   N   S   R   P   P   C   V   I

CTG TGA ctgcacaggactctgggttcctgctctgttctggggtccaaaccttggtct
L   *

ccctttggtcctgctgggagctcccccctgcctctttcccctacttagctccttagcaaa
gagaccctggcctccactttgccctttgggtacaaagaaggaatagaagattccgtggc
cttgggggcaggagagagacactctccatgaacacttctccagccacctctatcccctt
cccagggtaagtgcccacgaaagcccagtccactcttcgcctcggtaatacctgtctga
tgccacagattttatttattctcccctaacccagggcaatgtcagctatgggcagtaaa
gtggcgctac-polyA
```

FIG.10A

SERA

2C3 Mab

GM-CSF Production by line 4 after stimulation with native 21NT-A2 tumor, H16N2-A2 pulsed with different C35 peptides, or H16N2-A2 infected with C35 recombinant vaccinia virus

Western Blot with C35-specific Antibodies

Immunohistochemistry with 1F2 Antibody

Normal of 01A6 | Tumor of 01A6 | Control Mouse Ig

ANTIBODIES THAT BIND TO THE C35 POLYPEPTIDE

This application is a divisional of U.S. patent application Ser. No. 10/457,829, now U.S. Pat. No. 7,563,882, filed Jun. 10, 2003, which claims the benefit of U.S. Provisional Application No. 60/386,738, filed Jun. 10, 2002, and U.S. Provisional Application No. 60/432,241, filed Dec. 11, 2002, and U.S. Provisional Application No. 60/464,650, filed Apr. 23, 2003, the entire contents of which are hereby incorporated by reference in their entirety.

STATEMENT REGARDING FEDERALLY SPONSORED RESEARCH

Part of the work performed during development of this invention utilized U.S. Government funds. The U.S. Government has certain rights in this invention.

REFERENCE TO A SEQUENCE LISTING SUBMITTED ELECTRONICALLY VIA EFS-WEB

This application includes a "Sequence Listing," "substitute_sequence_listing_ascii.txt", 1,105,341 bytes, created on Nov. 1, 2010 and submitted electronically via EFS-Web which is hereby incorporated by reference in its entirety.

FIELD OF THE INVENTION

The present invention relates to a novel human gene that is differentially expressed in human breast and bladder carcinoma. More specifically, the present invention relates to a polynucleotide encoding a novel human polypeptide named C35. This invention also relates to C35 polypeptides, as well as vectors, host cells, antibodies directed to C35 polypeptides, and the recombinant methods for producing the same. The present invention further relates to diagnostic methods for detecting carcinomas, including human breast and bladder carcinomas. The present invention further relates to the formulation and use of the C35 gene and polypeptides in immunogenic compositions or vaccines, to induce antibody and cell-mediated immunity against target cells, such as tumor cells, that express the C35 gene. The invention further relates to screening methods for identifying agonists and antagonists of C35 activity.

BACKGROUND ART

Cancer afflicts approximately 1.2 million people in the United States each year. About 50% of these cancers are curable with surgery, radiation therapy, and chemotherapy. Despite significant technical advances in these three types of treatments, each year more than 500,000 people will die of cancer in the United States alone. (Jaffee, E. M., *Ann. N.Y. Acad. Sci.* 886:67-72 (1999)). Because most recurrences are at distant sites such as the liver, brain, bone, and lung, there is an urgent need for improved systemic therapies.

The goal of cancer treatment is to develop modalities that specifically target tumor cells, thereby avoiding unnecessary side effects to normal tissue. Immunotherapy has the potential to provide an alternative systemic treatment for most types of cancer. The advantage of immunotherapy over radiation and chemotherapy is that it can act specifically against the tumor without causing normal tissue damage. One form of immunotherapy, vaccines, is particularly attractive because they can also provide for active immunization, which allows for amplification of the immune response. In addition, vaccines can generate a memory immune response.

The possibility that altered features of a tumor cell are recognized by the immune system as non-self and may induce protective immunity is the basis for attempts to develop cancer vaccines. Whether or not this is a viable strategy depends on how the features of a transformed cell are altered. Appreciation of the central role of mutation in tumor transformation gave rise to the hypothesis that tumor antigens arise as a result of random mutation in genetically unstable cells. Although random mutations might prove immunogenic, it would be predicted that these would induce specific immunity unique for each tumor. This would be unfavorable for development of broadly effective tumor vaccines. An alternate hypothesis, however, is that a tumor antigen may arise as a result of systematic and reproducible tissue specific gene deregulation that is associated with the transformation process. This could give rise to qualitatively or quantitatively different expression of shared antigens in certain types of tumors that might be suitable targets for immunotherapy. Early results, demonstrating that the immunogenicity of some experimental tumors could be traced to random mutations (De Plaen, et al., *Proc. Natl. Acad. Sci. USA* 85: 2274-2278 (1988); Srivastava, & Old, *Immunol. Today* 9:78 (1989)), clearly supported the first hypothesis. There is, however, no a priori reason why random mutation and systematic gene deregulation could not both give rise to new immunogenic expression in tumors. Indeed, more recent studies in both experimental tumors (Sahasrabudhe et al., *J. Immunol.* 151:6202-6310 (1993); Torigoe et al., *J. Immunol.* 147:3251 (1991)) and human melanoma (van Der Bruggen et al., *Science* 254:1643-1647 (1991); Brichard et al., *J. Exp. Med.* 178:489-495 (1993); Kawakami et al., *Proc. Natl. Acad. Sci. USA* 91:3515-3519 (1994); Boel et al., *Immunity* 2:167-175 (1995); Van den Eynde et al., *J. Exp. Med.* 182: 689-698 (1995)) have clearly demonstrated expression of shared tumor antigens encoded by deregulated normal genes. The identification of MAGE-1 and other antigens common to different human melanoma holds great promise for the future development of multiple tumor vaccines.

In spite of the progress in melanoma, very few shared antigens recognized by cytotoxic T cells have not been described for other human tumors. The major challenge is technological. The most widespread and to date most successful approach to identify immunogenic molecules uniquely expressed in tumor cells is to screen a cDNA library with tumor-specific CTLs (cytotoxic T lymphocytes). Application of this strategy has led to identification of several gene families expressed predominantly in human melanoma. Two major limitations of this approach, however, are that (1) screening requires labor intensive transfection of numerous small pools of recombinant DNA into separate target populations, which themselves often need to be modified to express one or more MHC molecules required for antigen presentation, in order to assay T cell stimulation by a minor component of some pool; and (2) with the possible exception of renal cell carcinoma, tumor-specific CTLs have been very difficult to isolate from either tumor infiltrating lymphocytes (TIL) or PBL of patients with other types of tumors, especially the epithelial cell carcinomas that comprise greater than 80% of human tumors. It appears that there may be tissue specific properties that result in tumor-specific CTLs being sequestered in melanoma.

Direct immunization with tumor-specific gene products may be essential to elicit an immune response against some shared tumor antigens. It has been argued that, if a tumor expressed strong antigens, it should have been eradicated prior to clinical manifestation. Perhaps then, tumors express only weak antigens. Immunologists have long been interested in the issue of what makes an antigen weak or strong. There have been two major hypotheses. Weak antigens may be poorly processed and fail to be presented effectively to T cells. Alternatively, the number of T cells in the organism with appropriate specificity might be inadequate for a vigorous response (a so-called "hole in the repertoire"). Elucidation of the complex cellular process whereby antigenic peptides associate with MHC molecules for transport to the cell surface and presentation to T cells has been one of the triumphs of modern immunology. These experiments have clearly established that failure of presentation due to processing defects or competition from other peptides could render a particular peptide less immunogenic. In contrast, it has, for technical reasons, been more difficult to establish that the frequency of clonal representation in the T cell repertoire is an important mechanism of low responsiveness. Recent studies demonstrating that the relationship between immunodominant and cryptic peptides of a protein antigen change in T cell receptor transgenic mice suggest, however, that the relative frequency of peptide-specific T cells can, indeed, be a determining factor in whether a particular peptide is cryptic or dominant in a T cell response. This has encouraging implications for development of vaccines. With present day methods, it would be a complex and difficult undertaking to modify the way in which antigenic peptides of a tumor are processed and presented to T cells. The relative frequency of a specific T cell population can, however, be directly and effectively increased by prior vaccination. This could, therefore, be the key manipulation required to render an otherwise cryptic response immunoprotective. These considerations of cryptic or sub-dominant antigens have special relevance in relation to possible immune evasion by tumors through tolerance induction. Evidence has been presented to suggest that tumor-specific T cells in the tumor-bearing host are anergic, possibly as a result of antigen presentation on non-professional APC (Morgan, D. J. et al., *J. Immunol.* 163:723-27 (1999); Sotomayor, E. M. et al., *Proc. Natl. Acad. Sci. U.S.A.* 96:11476-81 (1999); Lee, P. P. et al., *Nature Medicine* 5:677-85 (1999)). Prior tolerization of T cells specific for immunodominant antigens of a tumor may, therefore, account for the difficulty in developing successful strategies for immunotherapy of cancer. These observations suggest that T cells specific for immunodominant tumor antigens are less likely to be effective for immunotherapy of established tumors because they are most likely to have been tolerized. It may, therefore, be that T cells specific for sub-dominant antigens or T cells that are initially present at a lower frequency would prove more effective because they have escaped the tolerizing influence of a growing tumor.

Another major concern for the development of broadly effective human vaccines is the extreme polymorphism of HLA class I molecules. Class I MHC:cellular peptide complexes are the target antigens for specific CD8+ CTLs. The cellular peptides, derived by degradation of endogenously synthesized proteins, are translocated into a pre-Golgi compartment where they bind to class I MHC molecules for transport to the cell surface. The CD8 molecule contributes to the avidity of the interaction between T cell and target by binding to the $\alpha 3$ domain of the class I heavy chain. Since all endogenous proteins turn over, peptides derived from any cytoplasmic or nuclear protein may bind to an MHC molecule and be transported for presentation at the cell surface. This allows T cells to survey a much larger representation of cellular proteins than antibodies which are restricted to recognize conformational determinants of only those proteins that are either secreted or integrated at the cell membrane.

The T cell receptor antigen binding site interacts with determinants of both the peptide and the surrounding MHC. T cell specificity must, therefore, be defined in terms of an MHC:peptide complex. The specificity of peptide binding to MHC molecules is very broad and of relatively low affinity in comparison to the antigen binding sites of specific antibodies. Class I-bound peptides are generally 8-10 residues in length and accommodate amino acid side chains of restricted diversity at certain key positions that match pockets in the MHC peptide binding site. These key features of peptides that bind to a particular MHC molecule constitute a peptide binding motif.

Hence, there exists a need for methods to facilitate the induction and isolation of T cells specific for human tumors, cancers and infected cells and for methods to efficiently select the genes that encode the major target antigens recognized by these T cells in the proper MHC-context.

BRIEF SUMMARY OF THE INVENTION

The present invention relates to a novel polynucleotide, C35, that is differentially expressed in human breast and bladder carcinoma, and to the encoded polypeptide of C35. Moreover, the present invention relates to vectors, host cells, antibodies, and recombinant methods for producing C35 polypeptides and polynucleotides. The present invention further relates to the formulation and use of C35 polypeptides, in particular C35 peptide epitopes and C35 peptide epitope analogs, and polynucleotides in immunogenic compositions to induce antibodies and cell-mediated immunity against target cells, such as tumor cells, that express the C35 gene products. Also provided are diagnostic methods for detecting disorders relating to the C35 genes and polypeptides, including use as a prognostic marker for carcinomas, such as human breast carcinoma, and therapeutic methods for treating such disorders. The invention further relates to screening methods for identifying binding partners of C35.

Thus, in one embodiment, the invention relates to an isolated polypeptide comprising a peptide comprising two or more C35 peptide epitopes, wherein said peptide is selected from the group consisting of: amino acids T101 to V113 of SEQ ID NO:2, E100 to V113 of SEQ ID NO:2, G99 to V113 of SEQ ID NO:2, I93 to V113 of SEQ ID NO:2, D88 to V113 of SEQ ID NO:2, P84 to V113 of SEQ ID NO:2, K77 to V113 of SEQ ID NO:2, Q72 to V113 of SEQ ID NO:2, F65 to V113 of SEQ ID NO:2, and L59 to V113 of SEQ ID NO:2, and wherein said isolated polypeptide is not SEQ ID NO: 2, SEQ ID NO: 153, SEQ ID NO: 155, or amino acids E100 to R109 of SEQ ID NO:2.

In another embodiment, the invention relates to an isolated polypeptide comprising at least one C35 peptide epitope analog, wherein said C35 peptide epitope analog is selected from the group consisting of: for the peptide epitope G22 to C30 of SEQ ID NO:2 and FIG. 1B, the analogs with either alanine or glycine substituted for cysteine at the ninth amino acid residue; for the peptide epitope I25 to C33 of SEQ ID NO:2 and FIG. 1B, the analogs with either alanine or glycine substituted for the cysteine at the sixth amino acid residue and/or the ninth amino acid residue; for the peptide epitope K77 to Y85 of SEQ ID NO: 2 and FIG. 1B, the analog with valine substituted for tyrosine at the ninth amino acid residue; for the peptide epitope K104 to C112 of SEQ ID NO:2 and FIG. 1B, the analogs with alanine, glycine or leucine substituted for cysteine at the ninth amino acid residue; for the peptide epitope K104 to V113 of SEQ ID NO:2 and FIG. 1B, the analogs with alanine, serine, glycine or leucine substituted for cysteine at the ninth amino acid residue; for the peptide epitope I105 to V113 of SEQ ID NO:2 and FIG. 1B, the analogs with either leucine or methionine substituted for threonine at the second amino acid residue and/or alanine, serine or glycine substituted for cysteine at the eighth amino acid residue; and for the peptide epitope N107 to L115 of SEQ ID NO:2 and FIG. 1B, the analog with either alanine or glycine substituted for cysteine at the sixth amino acid residue.

Preferably the isolated polypeptide of the invention is not more than 100 amino acids in length, alternatively not more that 95 amino acids in length, alternatively not more than 90 amino acids in length, alternatively not more than 85 amino acids in length, alternatively not more than 80 amino acids in length, alternatively not more than 75 amino acids in length, alternatively not more than 70 amino acids in length, alternatively not more than 65 amino acids in length, alternatively not more than 60 amino acids in length, alternatively not more than 55 amino acids in length, alternatively not more than 50 amino acids in length, alternatively not more than 45 amino acids in length, alternatively not more than 40 amino acids in length, or alternatively not more than 35 amino acids in length.

In another embodiment, the invention relates to a fusion protein comprising an isolated peptide comprising two or more C35 peptide epitopes, wherein said isolated peptide is selected from the group consisting of: amino acids T101 to V113 of SEQ ID NO:2, E100 to V113 of SEQ ID NO:2, G99 to V113 of SEQ ID NO:2, I93 to V113 of SEQ ID NO:2, D88 to V113 of SEQ ID NO:2, P84 to V113 of SEQ ID NO:2, K77 to V113 of SEQ ID NO:2, Q72 to V113 of SEQ ID NO:2, F65 to V113 of SEQ ID NO:2, and L59 to V113 of SEQ ID NO:2. In a preferred embodiment, the fusion protein is a homopolymer of said isolated peptide. In another preferred embodiment, the fusion protein is a heteropolymer of said isolated polypeptides. In yet another embodiment, the fusion protein is fused to a T helper peptide. In still another embodiment, the fusion protein is fused to a carrier. In another embodiment, the fusion protein is linked to a lipid.

In another embodiment, the invention relates to an isolated polypeptide consisting of two or more C35 peptide epitopes, wherein said isolated polypeptide is selected from the group consisting of: amino acids T101 to V113 of SEQ ID NO:2, E100 to V113 of SEQ ID NO:2, G99 to V113 of SEQ ID NO:2, I93 to V113 of SEQ ID NO:2, D88 to V113 of SEQ ID NO:2, P84 to V113 of SEQ ID NO:2, K77 to V113 of SEQ ID NO:2, Q72 to V113 of SEQ ID NO:2, F65 to V113 of SEQ ID NO:2, and L59 to V113 of SEQ ID NO:2, and wherein said isolated polypeptide is not SEQ ID NO: 2, SEQ ID NO: 153, SEQ ID NO: 155, or amino acids E100 to R109 of SEQ ID NO:2.

In another embodiment, the invention relates to an isolated polypeptide comprising a peptide comprising at least one C35 peptide epitope analog, wherein said peptide is selected from the group consisting of the analog of peptide T101 to V113 of SEQ ID NO:2 having either alanine or glycine substituted for the cysteine at the twelfth residue, the analog of peptide E100 to V113 of SEQ ID NO:2 having either alanine or glycine substituted for the cysteine at the thirteenth residue, the analog of peptide G99 to V113 of SEQ ID NO:2 having either alanine or glycine substituted for cysteine at the fourteenth residue, the analog of peptide I93 to V113 of SEQ ID NO:2 having either alanine or glycine substituted for the cysteine at the twentieth residue, the analog of peptide D88 to V113 of SEQ ID NO:2 having either alanine or glycine substituted for the cysteine at the twenty-fifth residue, the analog of peptide P84 to V113 of SEQ ID NO:2 having either alanine or glycine substituted for the cysteine at the twenty-ninth residue, the analog of peptide K77 to V113 of SEQ ID NO:2 having either alanine or glycine substituted for the cysteine at the thirty-sixth residue, the analog of peptide Q72 to V113 of SEQ ID NO:2 having either alanine or glycine substituted for the cysteine at the forty-first residue, the analog of peptide F65 to V113 of SEQ ID NO:2 having either alanine or glycine substituted for the cysteine at the forty-eighth residue, and the analog of peptide L59 to V113 of SEQ ID NO:2 having either alanine or glycine substituted for the cysteine at the fifty-fourth residue.

In another embodiment, the invention relates to a fusion protein comprising a peptide comprising at least one C35 peptide epitope analog, wherein said peptide is selected from the group consisting of: for the peptide epitope G22 to C30 of SEQ ID NO:2 and FIG. 1B, the analogs with either alanine or glycine substituted for cysteine at the ninth amino acid residue; for the peptide epitope I25 to C33 of SEQ ID NO:2 and FIG. 1B, the analogs with either alanine or glycine substituted for the cysteine at the sixth amino acid residue and/or the ninth amino acid residue; for the peptide epitope K77 to Y85 of SEQ ID NO: 2 and FIG. 1B, the analog with valine substituted for tyrosine at the ninth amino acid residue; for the peptide epitope K104 to C112 of SEQ ID NO:2 and FIG. 1B, the analogs with alanine, glycine or leucine substituted for cysteine at the ninth amino acid residue; for the peptide epitope K104 to V113 of SEQ ID NO:2 and FIG. 1B, the analogs with alanine, glycine, serine or leucine substituted for cysteine at the ninth amino acid residue; for the peptide epitope I105 to V113 of SEQ ID NO:2 and FIG. 1B, the analogs with either leucine, serine or methionine substituted for threonine at the second amino acid residue and/or alanine or glycine substituted for cysteine at the eighth amino acid residue; and for the peptide epitope N107 to V113 of SEQ ID NO:2 and FIG. 1B, the analog with either alanine or glycine substituted for cysteine at the sixth amino acid residue, the analog of peptide T101 to V113 of SEQ ID NO:2 having either alanine or glycine substituted for the cysteine at the twelfth residue, the analog of peptide E100 to V113 of SEQ ID NO:2 having either alanine or glycine substituted for cysteine at the thirteenth residue, the analog of peptide G99 to V113 of SEQ ID NO:2 having either alanine or glycine substituted for cysteine at the fourteenth residue, the analog of peptide I93 to V113 of SEQ ID NO:2 having either alanine or glycine substituted for the cysteine at the twentieth residue, the analog of peptide D88 to V113 of SEQ ID NO:2 having either alanine or glycine substituted for the cysteine at the twenty-fifth residue, the analog of peptide P84 to V113 of SEQ ID NO:2 having either alanine or glycine substituted for the cysteine at the twenty-ninth residue, the analog of peptide K77 to V113 of SEQ ID NO:2 having either alanine or glycine substituted for the cysteine at the thirty-sixth residue, the analog of peptide Q72 to V113 of SEQ ID NO:2 having either alanine or glycine substituted for the cysteine at the forty-first residue, the analog of peptide F65 to V113 of SEQ ID NO:2 having either alanine or glycine substituted for the cysteine at the forty-eighth residue, and the analog of peptide L59 to V113 of SEQ ID NO:2 having either alanine or glycine substituted for the cysteine at the fifty-fourth residue. In a preferred embodiment, the fusion protein comprises a homopolymer of said peptide comprising at least one C35 peptide epitope analog. In another preferred embodiment, the fusion protein comprises a heteropolymer of said peptide comprising at least one C35 peptide epitope analog.

In another embodiment, the invention relates to a composition comprising an isolated polypeptide or fusion protein of the invention and a pharmaceutically acceptable carrier.

BRIEF DESCRIPTION OF THE FIGURES

FIGS. 1A and 1B. FIG. 1A shows the DNA coding sequence (SEQ ID NO: 1) of C35. The sequence immediately upstream of the predicted ATG start codon is shown in lower case and conforms to the expected features described by Kozak, M., *J. Biol. Chem.* 266(30):19867-19870 (1991). FIG. 1B shows the deduced amino acid sequence (SEQ ID NO: 2) of C35. The asterisk ("*") represents a termination codon and signifies the end of the protein sequence.

FIG. 2A: C35 is overexpressed in Breast tumor cell lines. Upper Panel: 300 ng of poly-A RNA from 3 week old human thymus, normal breast epithelial cell line H16N2 from patient 21, and 4 breast tumor cell lines derived one year apart from primary or metastatic nodules of the same patient 21; 21NT, 21PT 21MT1, and 21MT2, was resolved on a 1% agarose/formaldehyde gel and transferred to a GENESCREEN™ membrane. This blot was hybridized with a $^{32}P$ labeled C35 probe. Hybridization was detected by exposing the blot to film for 15 hours. Lower Panel: To quantitate RNA loading, the same blot was stripped and re-hybridized with a $^{32}P$ labeled probe for Glyceraldehyde-3 Phosphate Dehydrogenase (GAPDH). For each sample the C35 signal was normalized to the GAPDH signal. The numbers represent the fold expression of C35 in each sample relative to H16N2. FIG. 2B: C35 is expressed at low levels in normal tissues. A Blot containing 1 microgram of poly-A RNA from each of the indicated adult normal tissues (Clontech) was hybridized with a $^{32}P$ labeled C35 probe. Hybridization was detected by exposing the blot to film for 15 hours (upper panel), or 96 hours (lower panel). FIG. 2C. C35 is overexpressed in primary Breast tumors. A blot containing 2 micrograms of poly-A RNA from 3 primary infiltrating ductal mammary carcinoma, T1, T2, T3 and 1 normal breast epithelium, N (Invitrogen) was hybridized with a $^{32}P$ labeled C35 probe. To normalize loading a $^{32}P$ labeled beta-Actin probe was included in the hybridization mix. Hybridization was detected by exposing the blot to film for 6 hours. The numbers represent the fold expression of C35 in each sample relative to normal breast epithelium.

FIG. 4A: 21NT. FIG. 4B: SKBR3. FIG. 4C: MDA-MB-231. These three breast tumor lines were selected to represent tumor cells that express high, intermediate and low levels of C35 RNA on Northern blots (see FIG. 3). Abbreviations: nms, ns; normal mouse serum; C35; C35 immune serum.

FIGS. 5A and 5B. CML Selected Recombinant Vaccinia cDNA Clones Stimulate Tumor Specific CTL. FIG. 5A: CML Selected vaccinia clones were assayed for the ability, following infection of B/C.N, to stimulate tumor specific CTL to secrete interferon gamma. The amount of cytokine was measured by ELISA, and is represented as OD490 (14). An OD490 of 1.4 is approximately equal to 4 ng/ml of IFNg, and an OD490 of 0.65 is approximately equal to 1 ng/ml of IFNg. FIG. 5B: CML selected clones sensitize host cells to lysis by tumor specific CTL. Monolayers of B/C.N in wells of a 6 well plate were infected with moi=1 of the indicated vaccinia virus clones. After 14 hours of infection the infected cells were harvested and along with the indicated control targets labeled with $^{51}Cr$. Target cells were incubated with the indicated ratios of tumor specific Cytotoxic T Lymphocytes for 4 hours at 37° C. and percentage specific lysis was determined (15). This experiment was repeated at least three times with similar results.

FIGS. 6A and 6B. The Tumor Antigen Is Encoded by a Ribosomal Protein L3 Gene. Sequence of H2.16 and rpL3 from amino acid position 45 to 56. FIG. 6A: The amino acid (in single letter code) (SEQ ID NO: 2143) and nucleotide sequence of cDNA clone rpL3 (GenBank Accession no. Y00225) (SEQ ID NO: 2144). FIG. 6B: A single nucleotide substitution at C170T of the H2.16 tumor cDNA is the only sequence change relative to the published L3 ribosomal allele. This substitution results in a T541 amino acid substitution in the protein (SEQ ID NO: 2145).

FIGS. 7A and 7B. Identification of the Peptide Epitope Recognized by the Tumor Specific CTL. FIG. 7A: CML assay to identify the peptide recognized by tumor specific CTL. Target cells were labeled with $^{51}Cr$ (15). During the $^{51}Cr$ incubation samples of B/C.N cells were incubated with 1 μM peptide $L3_{48-56}$(I54), 100 μM $L3_{48-56}$(T54) or 100 μM peptide $L3_{45-54}$(I54). Target cells were incubated with the indicated ratios of tumor specific Cytotoxic T Lymphocytes for 4 hours at 37° C. and percentage specific lysis was determined. This experiment was repeated at least three times with similar results. FIG. 7B: Titration of peptide $L3_{48-56}$ (I54). Target cells were labeled with $^{51}Cr$. During the $^{51}Cr$ incubation samples of B/C.N cells were incubated either with no peptide addition (D) or with the indicated concentrations (1 μM, 10 nM, 1 nM) of $L3_{48-56}$(I54) (■), BCA 39 cells were included as a positive control (▲). Target cells were incubated with the indicated ratios of Tumor Specific Cytotoxic T Lymphocytes for 4 hours at 37° C. and percentage specific lysis was determined. The experiment was repeated twice with similar results.

FIG. 8A: Sau3AI map of published rpL3 and H2.16. Shown above is the Sau3AI restriction map for the published ribosomal protein L3 gene (Top), and for H2.16 (Bottom). Digestion of cDNA for the published L3 sequence generates fragments of 200, 355, 348, 289, and 84 bp. The pattern for H2.16 is identical except for an extra Sau3AI site at position 168 caused by the C170T. This results in a 168 bp digestion product in place of the 200 bp fragment. FIG. 8B: The BCA tumors express both L3 alleles. RT-PCR products generated from each cell line or from vH2.16 were generated using L3 specific primers and then digested with Sau3AI, and resolved on a 3% agarose gel for 2 hours at 80 volts. FIG. 8C: The Immunogenic L3 allele is expressed at greatly reduced levels in B/C.N, BCB13, and Thymus. L3 specific RT-PCR products from each indicated sample were generated using a $^{32}P$ end labeled 5 prime PCR primer. No PCR product was observed when RNA for each sample was used as template for PCR without cDNA synthesis, indicating that no sample was contaminated with genomic DNA. The PCR products were gel purified to ensure purity, digested with Sau3AI, and resolved on a 3% agarose gel for 15 hours at 60 volts. No PCR product was observed in a control PCR sample that had no template added to it. This result has been reproduced a total of 3 times.

FIGS. 9A to 9C. Immunization with iL3 is Immunoprotective. FIG. 9A: Immunization with H2.16 induces tumor specific CTL. Balb/c mice (2/group) were immunized by subcutaneous injection with $5\times10^6$ pfu of vH2.16, or control vector v7.5/tk. Seven days later splenocytes were harvested and restimulated with peptide $L3_{48-56}$(I54) (26). Five days following the second restimulation the lymphocytes were tested in a chromium release assay as described in FIG. 11. The $L3_{48-56}$(I54) peptide was used at a 1 micromolar concentration, and the $L3_{48-56}$(T54) peptide was used at a 100 micromolar concentration. Similar results were obtained when the immunization experiment was repeated. FIGS. 9B and 9C: Female Balb/cByJ mice were immunized as indicated (27). The mice were challenged by SC injection with 200,000 viable BCA 34 tumor cells into the abdominal wall. Data is from day 35 post challenge. These data are representative of 4 independent experiments.

FIGS. 10A and 10B. FIG. 10A: C35 coding sequence with translation; (SEQ ID NO: 2)5' and 3' untranslated regions are shown in lowercase letters (SEQ ID NO: 2146). The predicted prenylation site, CVIL, at the 3' terminus is boxed. The asterisk ("*") represents a termination codon and signifies the end of the protein sequence. FIG. 10B: Genomic alignment of C35 gene on chromosome 17.

FIG. 11A: C35 expression in breast epithelial cell lines. FIG. 11B: C35 expression in primary breast tissue/tumors. 300 ng mRNA was electrophoresed on 0.8% alkaline agarose gels, then blotted to GENESCREEN PLUS™, except leftmost panel of B loaded with 1 μg mRNA from 3 primary tumors and 1 normal tissue control (Real Tumor Blots, Invitrogen). Similar exposures are shown for all blots.

FIG. 13A: Breast cell lines were stained with (top panel) sera from mice immunized with Line 1 cells infected with C35 recombinant retrovirus, and (bottom panel) 2C3 purified monoclonal antibody or isotype control. FIG. 13B: Bladder cell lines stained with 2C3 purified monoclonal antibody or isotype control.

FIG. 15A: T cell line 4 was generated from normal human PBL. FIG. 15B: T cell clone 10G3 was selected from line 4 for C35-specific activity. Target cell lines MEC, ppT11A3 and SV-HUC are naturally HLA-A2 positive. Target cell lines 21NT and H16N2 were transected with HLA-A2 to provide a required MHC restriction element.

FIG. 16A: IFN-gamma secretion. FIG. 16B: TNF-alpha secretion. Breast and bladder target cell lines were distinguished by the presence or absence of expression of HLA-A2 and C35 tumor antigen, an amino terminal 50 amino acid fragment of C35 (C35-50aa), or the irrelevant mouse L3 ribosomal protein. Each marker was either endogenously expressed or introduced by transfection of an HLA-A2.1 construct (pSV2.A2), or by infection with a vaccinia recombinant of C35 (vv.C35, vv.C35-50aa), L3 (vv.L3), or HLA-A2 (vv.A2)

DETAILED DESCRIPTION OF THE INVENTION

Definitions

The following definitions are provided to facilitate understanding of certain terms used throughout this specification.

In the present invention, "isolated" refers to material removed from its native environment (e.g., the natural environment if it is naturally occurring), and thus is altered "by the hand of man" from its natural state. For example, an isolated polynucleotide could be part of a vector or a composition of matter, or could be contained within a cell, and still be "isolated" because that vector, composition of matter, or particular cell is not the original environment of the polynucleotide.

Figure 4A:
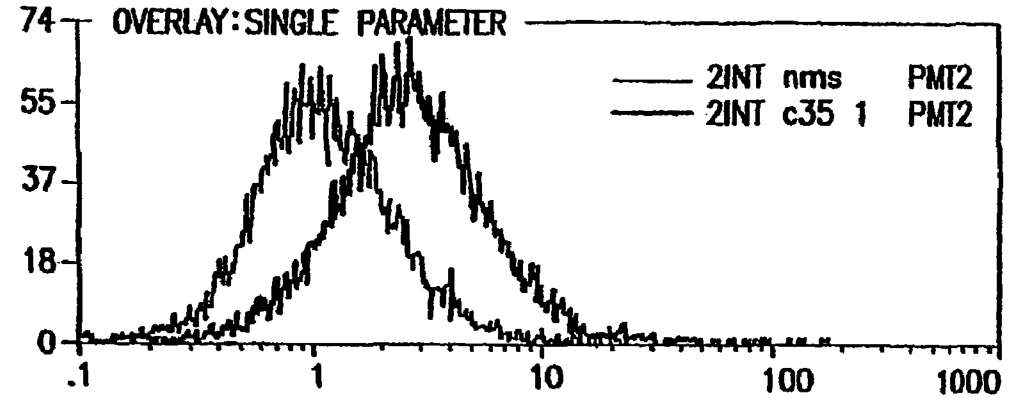
FIGS. 4A-4C. Surface Expression of C35 Protein Detected by Flow Cytometry. $1\times10^5$ breast tumor cells were stained with 3.5 microliters of antiserum raised in BALB/c mice against Line 1 mouse tumor cells transduced with retrovirus encoding human C35 or control, pre-bleed BALB/c serum. After a 30 minute incubation, cells were washed twice with staining buffer (PAB) and incubated with FITC-goat anti-mouse IgG (1 ug/sample) for 30 minutes. Samples were washed and analyzed on an EPICS Elite flow cytometer.
Figure 4B:
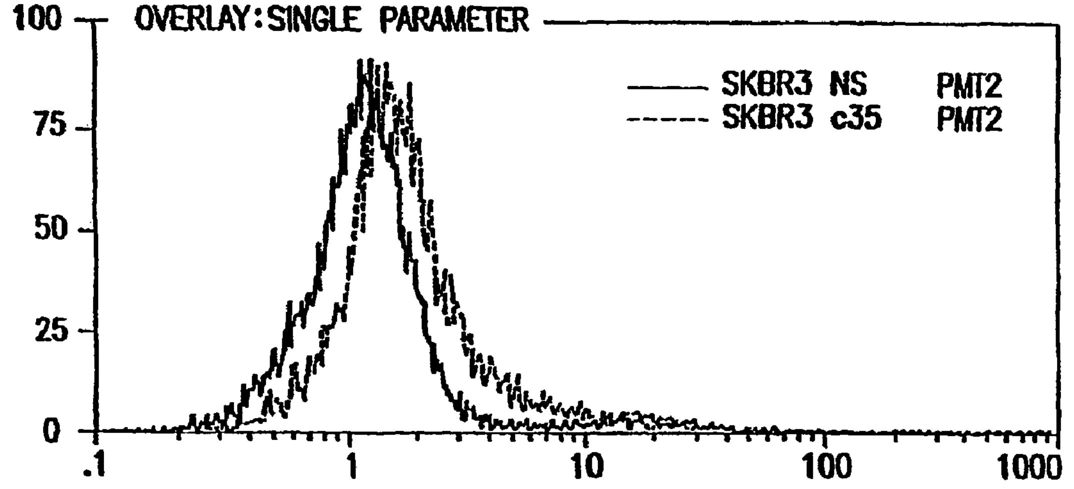
Figure 4C:
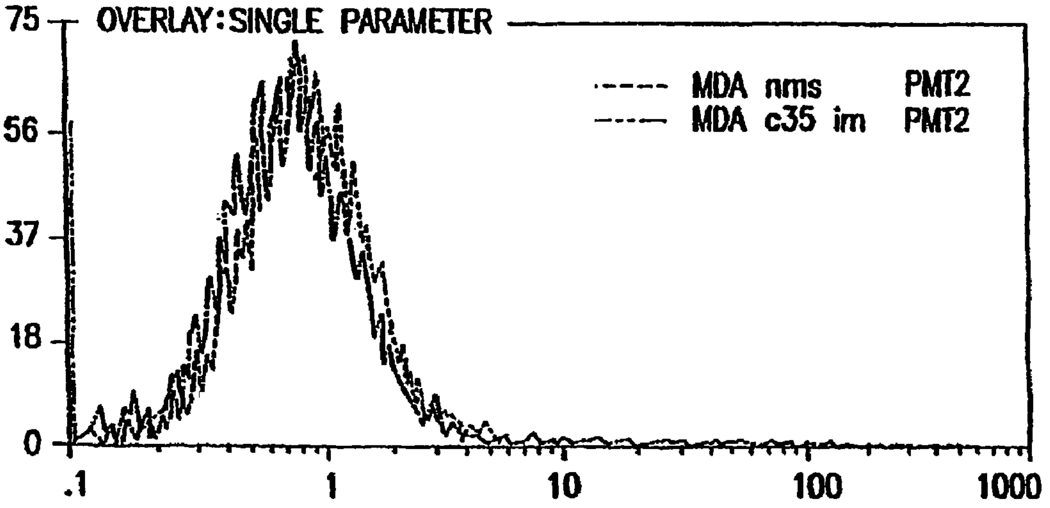

In the present invention, a "membrane" C35 protein is one expressed on the cell surface through either direct or indirect association with the lipid bilayer, including, in particular, through prenylation of a carboxyl-terminal amino acid motif. Prenylation involves the covalent modification of a protein by the addition of either a farnesyl or geranylgeranyl isoprenoid. Prenylation occurs on a cysteine residue located near the carboxyl-terminus of a protein. The C35 polypeptide contains the amino acids Cys-Val-Ile-Leu at positions 112-115 of SEQ ID NO:2, with the Leu being the C terminal residue of the polypeptide. The motif Cys-X-X-Leu SEQ ID NO:2142, where "X" represents any aliphatic amino acid, results in the addition of a 20 carbon geranylgeranyl group onto the Cys residue. Generally, following addition of this lipid the three terminal amino acid residues are cleaved off the polypeptide, and the lipid group is methylated. Prenylation promotes the membrane localization of most proteins, with sequence motifs in the polypeptide being involved in directing the prenylated protein to the plasma, nuclear, or golgi membranes. Prenylation plays a role in protein-protein interactions, and many prenylated proteins are involved in signal transduction. Examples of prenylated proteins include Ras and the nuclear lamin B. (Zhang, F. L. and Casey, P. J., *Ann. Rev. Biochem.* 65:241-269 (1996)). The C35 protein has been detected on the surface of two breast tumor cell lines by fluorescence analysis employing as a primary reagent a mouse anti-human C35 antiserum (FIGS. 4A-4C).

In the present invention, a "secreted" C35 protein refers to a protein capable of being directed to the ER, secretory vesicles, or the extracellular space as a result of a signal sequence, as well as a C35 protein released into the extracellular space without necessarily containing a signal sequence. If the C35 secreted protein is released into the extracellular space, the C35 secreted protein can undergo extracellular processing to produce a "mature" C35 protein. Release into the extracellular space can occur by many mechanisms, including exocytosis and proteolytic cleavage.

As used herein, a C35 "polynucleotide" refers to a molecule having a nucleic acid sequence contained in SEQ ID NO:1. For example, the C35 polynucleotide can contain the nucleotide sequence of the full length cDNA sequence, including the 5' and 3' untranslated sequences, the coding region, with or without the signal sequence, the secreted protein coding region, as well as fragments, epitopes, domains, and variants of the nucleic acid sequence. Moreover, as used herein, a C35 "polypeptide" refers to a molecule having the translated amino acid sequence generated from the polynucleotide as broadly defined.

In specific embodiments, the polynucleotides of the invention are less than 300 nt, 200 nt, 100 nt, 50 nt, 15 nt, 10 nt, or 7 nt in length. In a further embodiment, polynucleotides of the invention comprise at least 15 contiguous nucleotides of C35 coding sequence, but do not comprise all or a portion of any C35 intron. In another embodiment, the nucleic acid comprising C35 coding sequence does not contain coding sequences of a genomic flanking gene (i.e., 5' or 3' to the C35 gene in the genome).

In the present invention, the full length C35 coding sequence is identified as SEQ ID NO: 1.

A C35 "polynucleotide" also refers to isolated polynucleotides which encode the C35 polypeptides, and polynucleotides closely related thereto.

A C35 "polynucleotide" also refers to isolated polynucleotides which encode the amino acid sequence shown in SEQ ID NO: 2, or a biologically active fragment thereof.

A C35 "polynucleotide" also includes those polynucleotides capable of hybridizing, under stringent hybridization conditions, to sequences contained in SEQ ID NO: 1, the complement thereof, or the cDNA within the deposited clone. "Stringent hybridization conditions" refers to an overnight incubation at 42° in a solution comprising 50% formamide, 5×SSC (750 mM NaCl, 75 mM sodium citrate), 50 mM sodium phosphate (pH 7.6), 5×Denhardt's solution, 10% dextran sulfate, and 20 μg/ml denatured, sheared salmon sperm DNA, followed by washing the filters in 0.1×SSC at about 65°.

Of course, a polynucleotide which hybridizes only to polyA+ sequences (such as any 3' terminal polyA+ tract of a cDNA), or to a complementary stretch of T (or U) residues, would not be included in the definition of "polynucleotide," since such a polynucleotide would hybridize to any nucleic acid molecule containing a poly (A) stretch or the complement thereof (e.g., practically any double-stranded cDNA clone).

The C35 polynucleotide can be composed of any polyribonucleotide or polydeoxyribonucleotide, which may be unmodified RNA or DNA or modified RNA or DNA. For example, C35 polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. In addition, the C35 polynucleotides can be composed of triple-stranded regions comprising RNA or DNA or both RNA and DNA. C35 polynucleotides may also contain one or more modified bases or DNA or RNA backbones modified for stability or for other reasons. "Modified" bases include, for example, tritylated bases and unusual bases such as inosine. A variety of modifications can be made to DNA and RNA; thus, "polynucleotide" embraces chemically, enzymatically, or metabolically modified forms.

C35 polypeptides can be composed of amino acids joined to each other by peptide bonds or modified peptide bonds, i.e., peptide isosteres, and may contain amino acids other than the 20 gene-encoded amino acids. The C35 polypeptides may be modified by either natural processes, such as posttranslational processing, or by chemical modification techniques which are well known in the art. Such modifications are well described in basic texts and in more detailed monographs, as well as in a voluminous research literature. Modifications can occur anywhere in the C35 polypeptide, including the peptide backbone, the amino acid side-chains and the amino or carboxyl termini. It will be appreciated that the same type of modification may be present in the same or varying degrees at several sites in a given C35 polypeptide. Also, a given C35 polypeptide may contain many types of modifications. C35 polypeptides may be branched, for example, as a result of ubiquitination, and they may be cyclic, with or without branching. Cyclic, branched, and branched cyclic C35 polypeptides may result from posttranslation natural processes or may be made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, Proteins—Structure And Molecular Properties, 2nd Ed., T. E. Creighton, W. H. Freeman and Company, New York (1993); Posttranslational Covalent Modification of Proteins, B. C. Johnson, Ed., Academic Press, New York, pgs. 1-12 (1983); Seifter et al., *Meth Enzymol* 182:626-646 (1990); Rattan et al., *Ann NY Acad Sci* 663:48-62 (1992).)

"SEQ ID NO: 1" refers to a C35 polynucleotide sequence while "SEQ ID NO: 2" refers to a C35 polypeptide sequence.

A C35 polypeptide "having biological activity" refers to polypeptides exhibiting activity similar to, but not necessarily identical to, an activity of a C35 polypeptide, including mature forms, as measured in a particular biological assay, with or without dose dependency. In the case where dose dependency does exist, it need not be identical to that of the C35 polypeptide, but rather substantially similar to the dose-dependence in a given activity as compared to the C35 polypeptide (i.e., the candidate polypeptide will exhibit greater activity or not more than about 25-fold less and, preferably, not more than about tenfold less activity, and most preferably, not more than about three-fold less activity relative to the C35 polypeptide.)

C35 Polynucleotides and Polypeptides

A 348 base pair fragment of C35 was initially isolated by subtractive hybridization of poly-A RNA from tumor and normal mammary epithelial cell lines derived from the same patient with primary and infiltrating intraductal mammary carcinoma. Band, V. et al., *Cancer Res.* 50:7351-7357 (1990). Employing primers based on this sequence and that of an overlapping EST sequence (Accession No. W57569), a cDNA that includes the full-length C35 coding sequence was then amplified and cloned from the BT-20 breast tumor cell line (ATCC, HTB-19). This C35 cDNA contains the entire coding region identified as SEQ ID NO: 1. The C35 clone includes, in addition to the 348 bp coding sequence, 167 bp of 3' untranslated region. The open reading frame begins at an N-terminal methionine located at nucleotide position 1, and ends at a stop codon at nucleotide position 348 (FIG. 1A). A representative clone containing all or most of the sequence for SEQ ID NO:1 was deposited with the American Type Culture Collection ("ATCC") on Aug. 1, 2000, and was given the ATCC Deposit Number PTA-2310. The ATCC is located at 10801 University Boulevard, Manassas, Va. 20110-2209, USA. The ATCC deposit was made pursuant to the terms of the Budapest Treaty on the international recognition of the deposit of microorganisms for purposes of patent procedure.

Therefore, SEQ ID NO: 1 and the translated SEQ ID NO: 2 are sufficiently accurate and otherwise suitable for a variety of uses well known in the art and described further below. For instance, SEQ ID NO: 1 is useful for designing nucleic acid hybridization probes that will detect nucleic acid sequences contained in SEQ ID NO: 1 or the cDNA contained in the deposited clone. These probes will also hybridize to nucleic acid molecules in biological samples, thereby enabling a variety of forensic and diagnostic methods of the invention. Similarly, polypeptides identified from SEQ ID NO:2 may be used to generate antibodies which bind specifically to C35, or to stimulate T cells which are specific for C35 derived peptide epitopes in association with MHC molecules on the cell surface.

Nevertheless, DNA sequences generated by sequencing reactions can contain sequencing errors. The errors exist as misidentified nucleotides, or as insertions or deletions of nucleotides in the generated DNA sequence. The erroneously inserted or deleted nucleotides cause frame shifts in the reading frames of the predicted amino acid sequence. In these cases, the predicted amino acid sequence diverges from the actual amino acid sequence, even though the generated DNA sequence may be greater than 99.9% identical to the actual DNA sequence (for example, one base insertion or deletion in an open reading frame of over 1000 bases).

Accordingly, for those applications requiring precision in the nucleotide sequence or the amino acid sequence, the present invention provides not only the generated nucleotide sequence identified as SEQ ID NO: 1 and the predicted translated amino acid sequence identified as SEQ ID NO:2. The nucleotide sequence of the deposited C35 clone can readily be determined by sequencing the deposited clone in accordance with known methods. The predicted C35 amino acid sequence can then be verified from such deposits. Moreover, the amino acid sequence of the protein encoded by the deposited clone can also be directly determined by peptide sequencing or by expressing the protein in a suitable host cell containing the deposited human C35 cDNA, collecting the protein, and determining its sequence.

The present invention also relates to the C35 gene corresponding to SEQ ID NO:1, or the deposited clone. The C35 gene can be isolated in accordance with known methods using the sequence information disclosed herein. Such methods include preparing probes or primers from the disclosed sequence and identifying or amplifying the C35 gene from appropriate sources of genomic material.

Also provided in the present invention are species homologs of C35. Species homologs may be isolated and identified by making suitable probes or primers from the sequences provided herein and screening a suitable nucleic acid source for the desired homologue.

By "C35 polypeptide(s)" is meant all forms of C35 proteins and polypeptides described herein. The C35 polypeptides can be prepared in any suitable manner. Such polypeptides include isolated naturally occurring polypeptides, recombinantly produced polypeptides, synthetically produced polypeptides, or polypeptides produced by a combination of these methods. Means for preparing such polypeptides are well understood in the art.

The C35 polypeptides may be in the form of the membrane protein or a secreted protein, including the mature form, or may be a part of a larger protein, such as a fusion protein (see below). It is often advantageous to include an additional amino acid sequence which contains secretory or leader sequences, prosequences, sequences which aid in purification, such as multiple histidine residues, or an additional sequence for stability during recombinant production.

C35 polypeptides are preferably provided in an isolated form, and preferably are substantially purified. A recombinantly produced version of a C35 polypeptide, including the secreted polypeptide, can be substantially purified by the one step method described in Smith and Johnson, *Gene* 67:3140 (1988). C35 polypeptides also can be purified from natural or recombinant sources using antibodies of the invention raised against the C35 protein in methods which are well known in the art.

In one embodiment, the present invention is directed to an isolated polypeptide capable of eliciting a cytotoxic T lymphocyte and/or helper T lymphocyte response in a human subject, the isolated polypeptide comprising, or, alternatively, consisting of, one or more C35 peptide epitopes or C35 peptide epitope analogs. In a preferred embodiment, said one or more C35 peptide epitopes are selected from the group consisting of: amino acids E4 to P12 of SEQ ID NO:2, amino acids S9 to V17 of SEQ ID NO:2, amino acids S21 to Y29 of SEQ ID NO:2, G22 to C30 of SEQ ID NO:2, amino acids I25 to C33 of SEQ ID NO:2, amino acids T38 to V46 of SEQ ID NO:2, amino acids G61 to I69 of SEQ ID NO:2, amino acids T62 to N70 of SEQ ID NO:2, amino acids G63 to G71 of SEQ ID NO:2, amino acids F65 to L73 of SEQ ID NO:2, amino acids I67 to F75 of SEQ ID NO:2, amino acids K77 to Y85 of SEQ ID NO:2, amino acids Q72 to E86 of SEQ ID NO:2, amino acids G81 to L89 of SEQ ID NO:2, amino acids K104 to C112 of SEQ ID NO:2, amino acids K104 to V113 of SEQ ID NO:2, amino acids I105 to V113 of SEQ ID NO:2, and amino acids N107 to L115 of SEQ ID NO:2. In a preferred embodiment, the isolated polypeptides comprising one or more C35 peptide epitopes (e.g., one or more octamers, nonamers, decamers, 15mers, or 20mers in Tables 1-3 or 5-6) or C35 peptide epitope analogs (e.g., an analog listed in Table 4) are not more than 114 amino acids in length, more preferably not more than 110 amino acids in length, more preferably not more than 105 amino acids in length, more preferably not more than 100 amino acids in length, more preferably not more than 95 amino acids in length, more preferably not more than 90 amino acids in length, more preferably not more than 85 amino acids in length, more preferably not more than 80 amino acids in length, more preferably not more than 75 amino acids in length, more preferably not more than 70 amino acids in length, more preferably not more than 65 amino acids in length, more preferably not more than 60 amino acids in length, more preferably not more than 55 amino acids in length, more preferably not more than 50 amino acids in length, more preferably not more than 45 amino acids in length, more preferably not more than 40 amino acids in length, more preferably not more than 35 amino acids in length, more preferably not more than 30 amino acids in length, more preferably not more than 25 amino acids in length, more preferably 20 amino acids in length, more preferably 15 amino acids in length, more preferably 14, 13, 12, 11, 10, 9 or 8 amino acids in length. Of course, although not explicitly listed here, isolated polypeptides of any length between, for example, 8 and 100 amino acids, comprising C35 peptide epitopes or C35 peptide epitope analogs are likewise contemplated by the present invention. In a preferred embodiment, the isolated polypeptide is a fragment of the C35 polypeptide shown in SEQ ID NO:2 and FIG. 1B. In another embodiment, the present invention is directed to an isolated polypeptide capable of eliciting a cytotoxic T lymphocyte and/or helper T lymphocyte response in a human subject, the isolated polypeptide comprising, or, alternatively, consisting of multiple C35 peptide epitopes. In a particularly preferred embodiment, said multi-epitopepolypeptide is selected from the group consisting of: amino acids T101 to V113 of SEQ ID NO:2, amino acids E100 to V113 of SEQ ID NO:2, amino acids G99 to V113 of SEQ ID NO:2, amino acids I93 to V113 of SEQ ID NO:2, amino acids D88 to V113 of SEQ ID NO:2, amino acids P84 to V113 of SEQ ID NO:2, amino acids K77 to V113 of SEQ ID NO:2, amino acids Q72 to V113 of SEQ ID NO:2, amino acids F65 to V113 of SEQ ID NO:2, and amino acids L59 to V113 of SEQ ID NO:2. In another preferred embodiment, the present invention is directed to a fusion protein comprising at least one C35 peptide epitope listed in Tables 1-3 or 5-6, or a C35 peptide epitope analog listed in Table 4. In one embodiment, the at least one C35 peptide epitope or C35 peptide epitope analog is fused to a heterologous (i.e., non-C35) polypeptide. In another preferred embodiment, said fusion protein comprises two or more C35 peptide epitopes or two or more C35 peptide epitope analogs, either as a homopolymer or a heteropolymer. In another preferred embodiment, the fusion proteins of the present invention comprise at least one C35 peptide epitope analog joined to at least one C35 peptide epitope. In a further embodiment, the epitopes/analogs are joined by an amino acid spacer or linker.

The present invention is further directed to a pharmaceutical composition for use as a vaccine comprising such isolated polypeptides and fusion proteins.

The present invention is further directed to a method for stimulating a cytotoxic T lymphocyte and/or a helper T lymphocyte response in a human patient comprising administering to said patient an immunogenically effective amount of the pharmaceutical composition of the invention.

Polynucleotide and Polypeptide Variants

"Variant" refers to a polynucleotide or polypeptide differing from the C35 polynucleotide or polypeptide, but retaining essential properties thereof. Generally, variants are overall closely similar, and, in many regions, identical to the C35 polynucleotide or polypeptide.

By a polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence encoding the C35 polypeptide. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. The query sequence may be an entire sequence shown of SEQ ID NO:1, the ORF (open reading frame), or any fragment specified as described herein.

As a practical matter, whether any particular nucleic acid molecule or polypeptide is at least 90%, 95%, 96%, 97%, 98% or 99% identical to a nucleotide sequence or polypeptide sequence of the presence invention can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al., *Comp. App. Biosci.* 6:237245 (1990). In a sequence alignment the query and subject sequences are both DNA sequences. An RNA sequence can be compared by converting U's to T's. The result of said global sequence alignment is in percent identity. Preferred parameters used in a FASTDB alignment of DNA sequences to calculate percent identity are: Matrix=Unitary, ktuple=4, Mismatch Penalty=1, Joining Penalty=30, Randomization Group Length=0, Cutoff Score=1, Gap Penalty=5, Gap Size Penalty 0.05, Window Size=500 or the length of the subject nucleotide sequence, whichever is shorter.

If the subject sequence is shorter than the query sequence because of 5' or 3' deletions, not because of internal deletions, a manual correction must be made to the results. This is because the FASTDB program does not account for 5' and 3' truncations of the subject sequence when calculating percent identity. For subject sequences truncated at the 5' or 3' ends, relative to the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using the specified parameters, to arrive at a final percent identity score. This corrected score is what is used for the purposes of the present invention. Only bases outside the 5' and 3' bases of the subject sequence, as displayed by the FASTDB alignment, which are not matched/aligned with the query sequence, are calculated for the purposes of manually adjusting the percent identity score.

For example, a 90 base subject sequence is aligned to a 100 base query sequence to determine percent identity. The deletions occur at the 5' end of the subject sequence and therefore, the FASTDB alignment does not show a matched/alignment of the first 10 bases at 5' end. The 10 unpaired bases represent 10% of the sequence (number of bases at the 5' and 3' ends not matched/total number of bases in the query sequence) so 10% is subtracted from the percent identity score calculated by the FASTDB program. If the remaining 90 bases were perfectly matched the final percent identity would be 90%. In another example, a 90 base subject sequence is compared with a 100 base query sequence. This time the deletions are internal deletions so that there are no bases on the 5' or 3' of the subject sequence which are not matched/aligned with the query. In this case the percent identity calculated by FASTDB is not manually corrected. Once again, only bases 5' and 3' of the subject sequence which are not matched/aligned with the query sequence are manually corrected for. No other manual corrections are to made for the purposes of the present invention.

By a polypeptide having an amino acid sequence at least, for example, 95% "identical" to a query amino acid sequence of the present invention, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, or substituted with another amino acid. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

As a practical matter, whether any particular polypeptide is at least 90%, 95%, 96%, 97%, 98% or 99% identical to, for instance, the amino acid sequence shown in SEQ ID NO:2 or to the amino acid sequence encoded by deposited DNA clone, can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al., *Comp. App. Biosci.* 6:237245 (1990). In a sequence alignment the query and subject sequences are either both nucleotide sequences or both amino acid sequences. The result of said global sequence alignment is in percent identity. Preferred parameters used in a FASTDB amino acid alignment are: Matrix=PAM 0, ktuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter.

If the subject sequence is shorter than the query sequence due to N- or C-terminal deletions, not because of internal deletions, a manual correction must be made to the results. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence.

For example, a 90 amino acid residue subject sequence is aligned with a 100 residue query sequence to determine percent identity. The deletion occurs at the Nterminus of the subject sequence and therefore, the FASTDB alignment does not show a matching/alignment of the first 10 residues at the Nterminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- and C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected for. No other manual corrections are to be made for the purposes of the present invention.

The C35 variants may contain alterations in the coding regions, noncoding regions, or both. Especially preferred are polynucleotide variants containing alterations which produce silent substitutions, additions, or deletions, but do not alter the properties or activities of the encoded polypeptide. Nucleotide variants produced by silent substitutions due to the degeneracy of the genetic code are preferred. Moreover, variants in which 510, 15, or 12 amino acids are substituted, deleted, or added in any combination are also preferred. C35 polynucleotide variants can be produced for a variety of reasons, e.g., to optimize codon expression for a particular host (change codons in the human mRNA to those preferred by a bacterial host such as *E. coli*).

Naturally occurring C35 variants are called "allelic variants," and refer to one of several alternate forms of a gene occupying a given locus on a chromosome of an organism. (Genes II, Lewin, B., ed., John Wiley & Sons, New York (1985).) Also, allelic variants can occur as "tandem alleles" which are highly homologous sequences that occur at different loci on chromosomes of an organism. These allelic variants can vary at either the polynucleotide and/or polypeptide level. Alternatively, nonnaturally occurring variants may be produced by mutagenesis techniques or by direct synthesis.

Using known methods of protein engineering and recombinant DNA technology, variants may be generated to improve or alter the characteristics of the C35 polypeptides. For instance, one or more amino acids can be deleted from the Nterminus or Cterminus of the secreted protein without substantial loss of biological function. The authors of Ron et al., *J. Biol. Chem.* 268: 29842988 (1993), reported variant KGF proteins having heparin binding activity even after deleting 3, 8, or 27 aminoterminal amino acid residues. Similarly, Interferon gamma exhibited up to ten times higher activity after deleting 810 amino acid residues from the carboxy terminus of this protein (Dobeli et al., *J. Biotechnology* 7:199216 (1988)).

Moreover, ample evidence demonstrates that variants often retain a biological activity similar to that of the naturally occurring protein. For example, Gayle and coworkers (*J. Biol. Chem* 268:2210522111 (1993)) conducted extensive mutational analysis of human cytokine IL1a. They used random mutagenesis to generate over 3,500 individual IL1a mutants that averaged 2.5 amino acid changes per variant over the entire length of the molecule. Multiple mutations were examined at every possible amino acid position. The investigators found that "[m]ost of the molecule could be altered with little effect on either [binding or biological activity]." (See, Abstract.) In fact, only 23 unique amino acid sequences, out of more than 3,500 nucleotide sequences examined, produced a protein that significantly differed in activity from wildtype.

Furthermore, even if deleting one or more amino acids from the N-terminus or C-terminus of a polypeptide results in modification or loss of one or more biological functions, other biological activities may still be retained. For example, the ability of a deletion variant to induce and/or to bind antibodies which recognize the secreted form will likely be retained when less than the majority of the residues of the secreted form are removed from the N-terminus or C-terminus. Whether a particular polypeptide lacking N- or C-terminal residues of a protein retains such immunogenic activities can readily be determined by routine methods described herein and otherwise known in the art.

Thus, the invention further includes C35 polypeptide variants which show substantial biological activity. Such variants include deletions, insertions, inversions, repeats, and substitutions selected according to general rules known in the art so as to have little effect on activity. For example, guidance concerning how to make phenotypically silent amino acid substitutions is provided in Bowie, J. U. et al., *Science* 247: 13061310 (1990), wherein the authors indicate that there are two main strategies for studying the tolerance of an amino acid sequence to change.

The first strategy exploits the tolerance of amino acid substitutions by natural selection during the process of evolution. By comparing amino acid sequences in different species, conserved amino acids can be identified. These conserved amino acids are likely important for protein function. In contrast, the amino acid positions where substitutions have been tolerated by natural selection indicates that these positions are not critical for protein function. Thus, positions tolerating amino acid substitution could be modified while still maintaining biological activity of the protein.

The second strategy uses genetic engineering to introduce amino acid changes at specific positions of a cloned gene to identify regions critical for protein function. For example, site directed mutagenesis or alanine scanning mutagenesis (introduction of single alanine mutations at every residue in the molecule) can be used. (Cunningham and Wells, *Science* 244:10811085 (1989).) The resulting mutant molecules can then be tested for biological activity.

As the authors state, these two strategies have revealed that proteins are surprisingly tolerant of amino acid substitutions. The authors further indicate which amino acid changes are likely to be permissive at certain amino acid positions in the protein. For example, most buried (within the tertiary structure of the protein) amino acid residues require nonpolar side chains, whereas few features of surface side chains are generally conserved. Moreover, tolerated conservative amino acid substitutions involve replacement of the aliphatic or hydrophobic amino acids Ala, Val, Leu and Ile; replacement of the hydroxyl residues Ser and Thr; replacement of the acidic residues Asp and Glu; replacement of the amide residues Asn and Gln, replacement of the basic residues Lys, Arg, and His; replacement of the aromatic residues Phe, Tyr, and Trp, and replacement of the smallsized amino acids Ala, Ser, Thr, Met, and Gly.

Besides conservative amino acid substitution, variants of C35 include (i) substitutions with one or more of the nonconserved amino acid residues, where the substituted amino acid residues may or may not be one encoded by the genetic code, or (ii) substitution with one or more of amino acid residues having a substituent group, or (iii) fusion of the mature polypeptide with another compound, such as a compound to increase the stability and/or solubility of the polypeptide (for example, polyethylene glycol), or (iv) fusion of the polypeptide with additional amino acids, such as an IgG Fc fusion region peptide, or leader or secretory sequence, or a sequence facilitating purification. Such variant polypeptides are deemed to be within the scope of those skilled in the art from the teachings herein.

For example, C35 polypeptide variants containing amino acid substitutions of charged amino acids with other charged or neutral amino acids may produce proteins with improved characteristics, such as less aggregation. Aggregation of pharmaceutical formulations both reduces activity and increases clearance due to the aggregate's immunogenic activity. (Pinckard et al., *Clin. Exp. Immunol.* 2:331340 (1967); Robbins et al., *Diabetes* 36: 838845 (1987); Cleland et al., *Crit. Rev. Therapeutic Drug Carrier Systems* 10:307377 (1993).)

Polynucleotide and Polypeptide Fragments

In the present invention, a "polynucleotide fragment" refers to a short polynucleotide having a nucleic acid sequence contained in the deposited clone or shown in SEQ ID NO:1. The short nucleotide fragments are preferably at least about 15 nt, and more preferably at least about 20 nt, still more preferably at least about 30 nt, and even more preferably, at least about 40 nt in length. A fragment "at least 20 nt in length," for example, is intended to include 20 or more contiguous bases from the cDNA sequence contained in the deposited clone or the nucleotide sequence shown in SEQ ID NO:1. These nucleotide fragments are useful as diagnostic probes and primers as discussed herein. Of course, larger fragments (e.g., at least 50, 100, 150, 200, 250, 300 nucleotides) are preferred.

Moreover, representative examples of C35 polynucleotide fragments include, for example, fragments having a sequence from about nucleotide number 150, 51100, 101150, 151200, 201250, 251300, or 301 to the end of SEQ ID NO:1 or the cDNA contained in the deposited clone. In this context "about" includes the particularly recited ranges, larger or smaller by several (5, 4, 3, 2, or 1) nucleotides, at either terminus or at both termini. Preferably, these fragments encode a polypeptide which has biological activity. More preferably, these polynucleotides can be used as probes or primers as discussed herein.

In the present invention, a "polypeptide fragment" refers to a short amino acid sequence contained in SEQ ID NO:2 and FIG. 1B or encoded by the cDNA contained in the deposited clone. Protein fragments may be "freestanding," or comprised within a larger polypeptide of which the fragment forms a part or region, most preferably as a single continuous region. Representative examples of polypeptide fragments of the invention, include, for example, fragments from about amino acid number 120, 2140, 4160, 6180, 81100, or 101 to the end of the coding region. Moreover, polypeptide fragments can comprise about 7, 8, 9, 15, 20, 30, 40, 50, 60, 70, 80, 90, or 100 amino acids in length. In this context "about" includes the particularly recited ranges or lengths, larger or smaller by several (5, 4, 3, 2, or 1) amino acids, at either extreme or at both extremes.

Preferred polypeptide fragments include the secreted C35 protein as well as the mature form. Further preferred polypeptide fragments include the secreted C35 protein or the mature form having a continuous series of deleted residues from the amino or the carboxy terminus, or both. Further preferred polypeptide fragments include fragments of the C35 polypeptide comprising one or more C35 peptide epitopes.

As mentioned above, even if deletion of one or more amino acids from the Nterminus of a protein results in modification or loss of one or more biological functions of the protein, other biological activities may still be retained. Thus, the ability of shortened C35 muteins to induce and/or bind to antibodies which recognize the complete or mature forms of the polypeptides generally will be retained when less than the majority of the residues of the complete or mature polypeptide are removed from the Nterminus. Whether a particular polypeptide lacking Nterminal residues of a complete polypeptide retains such immunologic activities can readily be determined by routine methods described herein and otherwise known in the art. It is not unlikely that a C35 mutein with a large number of deleted Nterminal amino acid residues may retain some biological or immunogenic activities. In fact, in the case of C35 peptide epitopes, peptides composed of as few as 9, 8, or even 7 C35 amino acid residues often evoke an immune response.

Accordingly, the present invention further provides polypeptides having one or more residues deleted from the amino terminus of the C35 amino acid sequence shown in SEQ ID NO:2, up to the Threonine residue at position number 105 and polynucleotides encoding such polypeptides.

Also as mentioned above, even if deletion of one or more amino acids from the Cterminus of a protein results in modification or loss of one or more biological functions of the protein, other biological activities may still be retained. Thus, the ability of the shortened C35 mutein to induce cytotoxic T lymphocytes (CTLs) and/or helper T lymphocytes (HTLs) and/or to bind to antibodies which recognize the complete or mature forms of the polypeptide generally will be retained when less than the majority of the residues of the complete or mature polypeptide are removed from the Cterminus. Whether a particular polypeptide lacking Cterminal residues of a complete polypeptide retains such immunologic activities can readily be determined by routine methods described herein and otherwise known in the art. It is not unlikely that a C35 mutein with a large number of deleted Cterminal amino acid residues may retain some biological or immunogenic activities.

Accordingly, the present invention further provides polypeptides having one or more residues deleted from the carboxy terminus of the amino acid sequence of the C35 polypeptide shown in SEQ ID NO:2, up to the valine residue at position number 10, and polynucleotides encoding such polypeptides Moreover, the invention also provides polypeptides having one or more amino acids deleted from both the amino and the carboxyl termini. In preferred embodiments, the invention is directed to peptides having residues: E4 to P12, S9 to V17; V10 to V17; E16 to V23; E16 to R24; E16 to I25; S21 to Y29; S21 to F35; G22 to C30; I25 to C33; C30 to T38; E31 to Y39; E36 to A43; A37 to A45; A37 to V46; T38 to V46; Y39 to V46; S44 to I53; A45 to I53; G52 to L59; E54 to T62; S57 to F75; R58 to I67; L59 to V113; G61 to I69; T62 to N70, G63 to G71, G63 to F83; F65 to L73; F65 to V113; E66 to L73; E66 to V74; I67 to F75; K77 to Y85; K77 to V113; Q72 to E86; Q72 to V113; G81 to L89; F83 to E103; P84 to V113; D88 to A96; D88 to V113; L89 to A96; A92 to T101; I93 to V113; R95 to L102; A96 to K104; G99 to V113, E100 to V113, T101 to V113; K104 to C112; K104 to V113; I105 to V113; I105 to I114; or N107 to L115 of SEQ ID NO:2 and polynucleotides encoding such polypeptides.

Many polynucleotide sequences, such as EST sequences, are publicly available and accessible through sequence databases.

The human EST sequences referred to below were identified in a BLAST search of the EST database. These sequences are believed to be partial sequences of the cDNA inserts identified in the recited GenBank accession numbers. No homologous sequences were identified in a search of the annotated GenBank database. The Expect value (E) is a parameter that describes the number of hits one can "expect" to see just by chance when searching a database of a particular size. It decreases exponentially with the Score (S) that is assigned to a match between two sequences. Essentially, the E value describes the random background noise that exists for matches between sequences. In BLAST 2.0, the Expect value is also used instead of the P value (probability) to report the significance of matches. For example, an E value of 1 assigned to a hit can be interpreted as meaning that in a database of the current size one might expect to see 1 match with a similar score simply by chance.

For example, the following sequences are related to SEQ ID NO: 1, GenBank Accession Nos.: AA971857 (SEQ ID NO:3); W57569 (SEQ ID NO:4); AI288765 (SEQ ID NO:5); W65390 (SEQ ID NO:6); W37432 (SEQ ID NO: 7); N42748 (SEQ ID NO:8); AA971638 (SEQ ID NO:9); R22331 (SEQ ID NO:10); AA308370 (SEQ ID NO:11); AA285089 (SEQ ID NO:12); R68901 (SEQ ID NO:13); AA037285 (SEQ ID NO:14); H94832 (SEQ ID NO:15); H96058 (SEQ ID NO:16); H56522 (SEQ ID NO:17); AA935328 (SEQ ID NO: 18); AW327450 (SEQ ID NO:19); AW406075 (SEQ ID NO:20); AW406223 (SEQ ID NO:21); AI909652 (SEQ ID NO:22); AA026773 (SEQ ID NO: 23); H96055 (SEQ ID NO:24); H12836 (SEQ ID NO:25); R22401 (SEQ ID NO:26); N34596 (SEQ ID NO:27); W32121 (SEQ ID NO:28); T84927 (SEQ ID NO:29); R63575 (SEQ ID NO:30); R23139 (SEQ ID NO:31); AA337071 (SEQ ID NO:32); AA813244 (SEQ ID NO:33); AA313422 (SEQ ID NO:34); N31910 (SEQ ID NO:35); N42693 (SEQ ID NO:36); N32532 (SEQ ID NO:37); AA375119 (SEQ ID NO:38); R32153 (SEQ ID NO:39); R23369 (SEQ ID NO:40); AA393628 (SEQ ID NO:41); H12779 (SEQ ID NO:42); AI083674 (SEQ ID NO:43); AA284919 (SEQ ID NO:44); AA375286 (SEQ ID NO:45); AA830592 (SEQ ID NO:46); H95363 (SEQ ID NO:47); T92052 (SEQ ID NO:48); AI336555 (SEQ ID NO:49); AI285284 (SEQ ID NO:50); AA568537 (SEQ ID NO:51); AI041967 (SEQ ID NO:52); W44577 (SEQ ID NO:53); R22332 (SEQ ID NO:54); N27088 (SEQ ID NO:55); H96418 (SEQ ID NO:56); AI025384 (SEQ ID NO:57); AA707623 (SEQ ID NO:58); AI051009 (SEQ ID NO:59); AA026774 (SEQ ID NO:60); W51792 (SEQ ID NO:61); AI362693 (SEQ ID NO:62); AA911823 (SEQ ID NO:63); H96422 (SEQ ID NO:64); AI800991 (SEQ ID NO:65); AI525314 (SEQ ID NO:66); AI934846 (SEQ ID NO:67); AI937133 (SEQ ID NO:68); AW006797 (SEQ ID NO:69); AI914716 (SEQ ID NO:70); AI672936 (SEQ ID NO:71); W61294 (SEQ ID NO:72); AI199227 (SEQ ID NO:73); AI499727 (SEQ ID NO:74); R32154 (SEQ ID NO:75); AI439771 (SEQ ID NO:76); AA872671 (SEQ ID NO:77); AA502178 (SEQ ID NO:78); N26715 (SEQ ID NO:79); AA704668 (SEQ ID NO:80); R68799 (SEQ ID NO:81); H56704 (SEQ ID NO:82); AI360416 (SEQ ID NO:83).

Thus, in one embodiment the present invention is directed to polynucleotides comprising the polynucleotide fragments and full-length polynucleotide (e.g. the coding region) described herein exclusive of one or more of the above-recited ESTs. Also, the nucleotide sequences in SEQ ID NO: 152, SEQ ID NO: 154, and SEQ ID NO: 156 are excluded from the present invention.

Also preferred are C35 polypeptide and polynucleotide fragments characterized by structural or functional domains. Preferred embodiments of the invention include fragments that comprise MHC binding epitopes and prenylation sites.

Other preferred fragments are biologically active C35 fragments. Biologically active fragments are those exhibiting activity similar, but not necessarily identical, to an activity of the C35 polypeptide. The biological activity of the fragments may include an improved desired activity, or a decreased undesirable activity.

Epitopes & Antibodies

Cellular peptides derived by degradation of endogenously synthesized proteins are translocated into a pre-Golgi compartment where they bind to Class I or Class II MHC molecules for transport to the cell surface. These class I MHC: peptide complexes are the target antigens for specific CD8+ cytotoxic T cells. Since all endogenous proteins "turn over," peptides derived from any cytoplasmic or nuclear protein may bind to an MHC molecule and be transported for presentation at the cell surface. This allows T cells to survey a much larger representation of cellular proteins than antibodies which are restricted to recognize conformational determinants of only those proteins that are either secreted or integrated at the cell membrane. The T cell receptor antigen binding site interacts with determinants of both the peptide and the surrounding MHC. T cell specificity must, therefore, be defined in terms of an MHC:peptide complex. The specificity of peptide binding to MHC molecules is very broad and of relatively low affinity in comparison to the antigen binding site of specific antibodies. Class I-bound peptides are generally 8-10 residues in length that accommodate amino acid side chains of restricted diversity at certain key positions that match pockets in the MHC peptide binding site. These key features of peptides that bind to a particular MHC molecule constitute a peptide binding motif.

The term "derived" when used to discuss a peptide epitope is a synonym for "prepared." A derived epitope can be isolated from a natural source, or it can be synthesized in accordance with standard protocols in the art. Synthetic epitopes can comprise artificial amino acids "amino acid mimetics," such as D isomers of natural occurring L amino acids or non-natural amino acids such as cyclohexylalanine. A derived/prepared epitope can be an analog of a native epitope.

An "epitope" is the collective features of a molecule, such as primary, secondary and tertiary peptide structure, and charge, that together form a site recognized by an immunoglobulin, T cell receptor or HLA molecule. Alternatively, an epitope can be defined as a set of amino acid residues which is involved in recognition by a particular immunoglobulin, or in the context of T cells, those residues necessary for recognition by T cell receptor proteins and/or Major Histocompatibility Complex (MHC) receptors. Epitopes are present in nature, and can be isolated, purified or otherwise prepared/derived by humans. For example, epitopes can be prepared by isolation from a natural source, or they can be synthesized in accordance with standard protocols in the art. Synthetic epitopes can comprise artificial amino acids "amino acid mimetics," such as D isomers of natural occurring L amino acids or non-natural amino acids such as cyclohexylalanine. Throughout this disclosure, the terms epitope and peptide are often used interchangeably. Also, the term epitope as used herein is generally understood to encompass analogs of said epitopes.

It is to be appreciated that protein or polypeptide molecules that comprise one or more C35 peptide epitopes of the invention as well as additional amino acid(s) are still within the bounds of the invention. In certain embodiments, there is a limitation on the length of a polypeptide of the invention of, for example, not more than 114 amino acids, not more than 110 amino acids, not more than 100 amino acids, not more than 95 amino acids, not more than 90 amino acids, not more than 85 amino acids, not more than 80 amino acids, not more than 75 amino acids, not more than 70 amino acids, not more than 65 amino acids, not more than 60 amino acids, not more than 55 amino acids, not more than 50 amino acids, not more than 45 amino acids, not more than 40 amino acids, not more than 35 amino acids, not more than 30 amino acids, not more than 25 amino acids, 20 amino acids, 15 amino acids, or 14, 13, 12, 11, 10, 9 or 8 amino acids. In some instances, the embodiment that is length-limited occurs when the protein/polypeptide comprising an epitope of the invention comprises a region (i.e., a contiguous series of amino acids) having 100% identity with a native sequence. In order to avoid the definition of epitope from reading, e.g., on whole natural molecules, there is a limitation on the length of any region that has 100% identity with a native polypeptide sequence. Thus, for a polypeptide comprising an epitope of the invention and a region with 100% identity with the native C35 polypeptide sequence, the region with 100% identity to the native sequence generally has a length of: less than or equal to 114 amino acids, more often less than or equal to 100 amino acids, often less than or equal to 85 amino acids, often less than or equal to 75 amino acids, often less than or equal to 65 amino acids, and often less than or equal to 50 amino acids. In certain embodiments, the C35 polypeptide of the invention comprises a peptide having a region with less than 50 amino acids that has 100% identity to a native peptide sequence, in any increment of amino acids (i.e., 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5) down to 5 amino acids. Preferably, such C35 polypeptide comprises one or more C35 peptide epitopes.

Accordingly, polypeptide or protein sequences longer than 100 amino acids are within the scope of the invention, so long as they do not comprise any contiguous sequence of more than 114 amino acids that have 100% identity with a native polypeptide sequence. For any polypeptide that has five contiguous residues or less that correspond to a native sequence, there is no limitation on the maximal length of that polypeptide in order to fall within the scope of the invention. In one embodiment, the polypeptide of the invention comprising one or more C35 peptide epitopes is less than 60 residues long in any increment down to eight amino acid residues.

An "immunogenic peptide" or "peptide epitope" is a peptide that will bind an HLA molecule and induce a cytotoxic T lymphocyte (CTL) response and/or a helper T lymphocyte (HTL) response. Thus, immunogenic peptides of the invention are capable of binding to an appropriate HLA molecule and thereafter inducing a cytotoxic T lymphocyte (CTL) response, or a helper T lymphocyte (HTL) response, to the peptide.

The term "motif" refers to a pattern of residues in an amino acid sequence of defined length, usually a peptide of from about 8 to about 13 amino acids for a class I HLA motif and from about 16 to about 25 amino acids for a class II HLA motif, which is recognized by a particular HLA molecule. Motifs are typically different for each HLA protein encoded by a given human HLA allele. These motifs often differ in their pattern of the primary and secondary anchor residues.

A "protective immune response" or "therapeutic immune response" refers to a cytotoxic T lymphocyte (CTL) and/or an helper T lymphocyte (HTL) response to an antigen derived from an pathogenic antigen (e.g., an antigen from an infectious agent or a tumor antigen), which in some way prevents or at least partially arrests disease symptoms, side effects or progression. The immune response may also include an antibody response which has been facilitated by the stimulation of helper T cells.

The term "residue" refers to an amino acid or amino acid mimetic incorporated into a peptide or protein by an amide bond or amide bond mimetic.

"Synthetic peptide" refers to a peptide that is not naturally occurring, but is man-made using such methods as chemical synthesis or recombinant DNA technology.

As used herein, a "vaccine" is a composition that contains one or more peptide epitopes of the invention, see, e.g., Tables 1-3 and 5-6, exclusive of peptide E-100 to R-109, and a pharmaceutically acceptable carrier. There are numerous embodiments of vaccines in accordance with the invention, such as by a cocktail of one or more peptides; a polyepitopic peptide comprising one or more peptides of the invention; or nucleic acids that encode such peptides or polypeptides, e.g., a minigene that encodes a polyepitopic peptide. The "one or more peptides" or "one or more epitopes" can include, for example, at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 85, 90, 95, or 100 or more peptides or epitopes of the invention. The peptides or polypeptides can optionally be modified, such as by lipidation, addition of targeting or other sequences. HLA class I-binding peptides of the invention can be linked to HLA class II-binding peptides, to facilitate activation of both cytotoxic T lymphocytes and helper T lymphocytes. Vaccines can comprise peptide pulsed antigen presenting cells, e.g., dendritic cells.

In a preferred embodiment, the isolated polypeptides of the present invention comprise or, alternatively, consist of one or more of the following C35 peptide epitopes: amino acids E4 to P12 of SEQ ID NO:2, amino acids S9 to V17 of SEQ ID NO:2, amino acids S21 to Y29 of SEQ ID NO:2, G22 to C30 of SEQ ID NO: 2, amino acids I25 to C33 of SEQ ID NO:2, amino acids T38 to V46 of SEQ ID NO:2, amino acids G61 to I69 of SEQ ID NO:2, amino acids T62 to N70 of SEQ ID NO:2, amino acids G63 to G71 of SEQ ID NO:2, amino acids F65 to L73 of SEQ ID NO:2, amino acids I67 to F75 of SEQ ID NO:2, amino acids K77 to Y85 of SEQ ID NO:2, amino acids Q72 to E86 of SEQ ID NO:2, amino acids G81 to L89 of SEQ ID NO:2, amino acids K104 to C112 of SEQ ID NO:2, amino acids K104 to V113 of SEQ ID NO:2, amino acids I105 to V113 of SEQ ID NO:2, or amino acids N107 to L115 of SEQ ID NO:2. In another embodiment, said polypeptides comprising or, alternatively, consisting of one or more C35 peptide epitopes are selected from the group consisting of: T101 to V113 of SEQ ID NO:2, G99 to V113 of SEQ ID NO:2, E100 to V113 of SEQ ID NO:2, I93 to V113 of SEQ ID NO:2, D88 to V113 of SEQ ID NO:2, P84 to V113 of SEQ ID NO:2, K77 to V113 of SEQ ID NO:2, Q72 to V113 of SEQ ID NO:2, F65 to V113 of SEQ ID NO:2, and L59 to V113 of SEQ ID NO:2. It is contemplated that fragments of C35 peptide epitopes and polypeptides comprising fragments of C35 peptide epitopes of the invention will, in some instances, also be useful for stimulating a cytotoxic T lymphocyte response. Thus, the present invention includes fragments of the C35 peptide epitopes in which 1, 2, 3, 4, 5 or more amino acids of the peptide sequence provided have been deleted from either the amino terminus or the carboxy terminus of the peptide. In addition, it is contemplated that larger fragments of the C35 polypeptide that contain one or more of the peptide epitopes of the invention may also be used to stimulate a CTL response in a patient. It is further contemplated that polypeptides that comprise one or more peptide epitopes of the present invention in addition to heterologous, i.e., non-C35, flanking sequences may also be used to stimulate a CTL response.

In addition to the specific C35 peptide epitopes specifically listed above, many other peptide epitopes are contemplated by the present invention. Thus, the isolated polypeptides of the present invention comprising or, alternatively, consisting of, one or more C35 peptide epitopes include the following 8mers (residues correspond to SEQ ID NO:2 and FIG. 1B): M1 to T8; S2 to S9; G3 to V10; E4 to A11; P5 to P12; G6 to P13; Q7 to P14; T8 to E15; S9 to E16; V10 to V17; A11 to E18; P12 to P19; P13 to G20; P14 to S21; E15 to G22; E16 to V23; V17 to R24; E18 to I25; P19 to V26; G20 to V27; S21 to E28; G22 to Y29; V23 to C30; R24 to E31; I25 to P32; V26 to C33; V27 to G34; E28 to F35; Y29 to E36; C30 to A37; E31 to T38; P32 to Y39; C33 to L40; G34 to E41; F35 to L42; E36 to A43; A37 to S44; T38 to A45; Y39 to V46; L40 to K47; E41 to E48; L42 to Q49; A43 to Y50; S44 to P51; A45 to G52; V46 to I53; K47 to E54; E48 to I55; Q49 to E56; Y50 to S57; P51 to R58; G52 to L59; I53 to G60; E54 to G61; I55 to T62; E56 to G63; S57 to A64; R58 to F65; L59 to E66; G60 to I67; G61 to E68; T62 to I69; G63 to N70; A64 to G71; F65 to Q72; E66 to L73; I67 to V74; E68 to F75; I69 to S76; N70 to K77; G71 to L78; Q72 to E79; L73 to N80; V74 to G81; F75 to G82; S76 to F83; K77 to P84; L78 to Y85; E79 to E86; N80 to K87; G81 to D88; G82 to L89; F83 to I90; P84 to E91; Y85 to A92; E86 to I93; K87 to R94; D88 to R95; L89 to A96; I90 to S97; E91 to N98; A92 to G99; I93 to E100; R94 to T101; R95 to L102; A96 to E103; S97 to K104; N98 to I105; G99 to T106; E100 to N107; T101 to S108; L102 to R109; E103 to P110; K104 to P111; I105 to C112; T106 to V113; N107 to I114; and S108 to L115.

In a further embodiment, the isolated polypeptides of the present invention comprising or, alternatively, consisting of, one or more C35 peptide epitopes include the following 9mers (residues correspond to SEQ ID NO:2 and FIG. 1B): M1 to S9; S2 to V10; G3 to A11; E4 to P12; P5 to P13; G6 to P14; Q7 to E15; T8 to E16; S9 to V17; V10 to E18; A11 to P19; P12 to G20; P13 to S21; P14 to G22; E15 to V23; E16 to R24; V17 to I25; E18 to V26; P19 to V27; G20 to E28; S21 to Y29; G22 to C30; V23 to E31; R24 to P32; I25 to C33; V26 to G34; V27 to F35; E28 to E36; Y29 to A37; C30 to T38; E31 to Y39; P32 to L40; C33 to E41; G34 to L42; F35 to A43; E36 to S44; A37 to A45; T38 to V46; Y39 to K47; L40 to E48; E41 to Q49; L42 to Y50; A43 to P51; S44 to G52; A45 to I53; V46 to E54; K47 to I55; E48 to E56; Q49 to S57; Y50 to R58; P51 to L59; G52 to G60; I53 to G61; E54 to T62; I55 to G63; E56 to A64; S57 to F65; R58 to E66; L59 to I67; G60 to E68; G61 to I69; T62 to N70; G63 to G71; A64 to Q72; F65 to L73; E66 to V74; I67 to F75; E68 to S76; I69 to K77; N70 to L78; G71 to E79; Q72 to N80; L73 to G81; V74 to G82; F75 to F83; S76 to P84; K77 to Y85; L78 to E86; E79 to K87; N80 to D88; G81 to L89; G82 to I90; F83 to E91; P84 to A92; Y85 to I93; E86 to R94; K87 to R95; D88 to A96; L89 to S97; I90 to N98; E91 to G99; A92 to E100; I93 to T101; R94 to L102; R95 to E103; A96 to K104; S97 to I105; N98 to T106; G99 to N107; E100 to S108; T101 to R109; L102 to P110; E103 to P111; K104 to C112; I105 to V113; T106 to I114; and N107 to L115.

In a further embodiment, the isolated polypeptides of the present invention comprising or, alternatively, consisting of, one or more C35 peptide epitopes include the following 10mers (residues correspond to SEQ ID NO:2 and FIG. 1B): M1 to V10; S2 to A11; G3 to P12; E4 to P13; P5 to P14; G6 to E15; Q7 to E16; T8 to V17; S9 to E18; V10 to P19; A11 to G20; P12 to S21; P13 to G22; P14 to V23; E15 to R24; E16 to I25; V17 to V26; E18 to V27; P19 to E28; G20 to Y29; S21 to C30; G22 to E31; V23 to P32; R24 to C33; I25 to G34; V26 to F35; V27 to E36; E28 to A37; Y29 to T38; C30 to Y39; E31 to L40; P32 to E41; C33 to L42; G34 to A43; F35 to S44; E36 to A45; A37 to V46; T38 to K47; Y39 to E48; L40 to Q49; E41 to Y50; L42 to P51; A43 to G52; S44 to I53; A45 to E54; V46 to I55; K47 to E56; E48 to S57; Q49 to R58; Y50 to L59; P51 to G60; G52 to G61; I53 to T62; E54 to G63; I55 to A64; E56 to F65; S57 to E66; R58 to I67; L59 to E68; G60 to I69; G61 to N70; T62 to G71; G63 to Q72; A64 to L73; F65 to V74; E66 to F75; I67 to S76; E68 to K77; I69 to L78; N70 to E79; G71 to N80; Q72 to G81; L73 to G82; V74 to F83; F75 to P84; S76 to Y85; K77 to E86; L78 to K87; E79 to D88; N80 to L89; G81 to I90; G82 to E91; F83 to A92; P84 to I93; Y85 to R94; E86 to R95; K87 to A96; D88 to S97; L89 to N98; I90 to G99; E91 to E100; A92 to T101; I93 to L102; R94 to E103; R95 to K104; A96 to I105; S97 to T106; N98 to N107; G99 to S108; E100 to R109; T101 to P110; L102 to P111; E103 to C112; K104 to V113; I105 to I114; T106 to L115.

In a further embodiment, the isolated polypeptides of the present invention comprising or, alternatively, consisting of, one or more C35 peptide epitopes include the following 11mers (residues correspond to SEQ ID NO:2 and FIG. 1B): M1 to A11; S2 to P12; G3 to P13; E4 to P14; P5 to E15; G6 to E16; Q7 to V17; T8 to E18; S9 to P19; V10 to G20; A11 to S21; P12 to G22; P13 to V23; P14 to R24; E15 to I25; E16 to V26; V17 to V27; E18 to E28; P19 to Y29; G20 to C30; S21 to E31; G22 to P32; V23 to C33; R24 to G34; I25 to F35; V26 to E36; V27 to A37; E28 to T38; Y29 to Y39; C30 to L40; E31 to E41; P32 to L42; C33 to A43; G34 to S44; F35 to A45; E36 to V46; A37 to K47; T38 to E48; Y39 to Q49; L40 to Y50; E41 to P51; L42 to G52; A43 to I53; S44 to E54; A45 to I55; V46 to E56; K47 to S57; E48 to R58; Q49 to L59; Y50 to G60; P51 to G61; G52 to T62; I53 to G63; E54 to A64; I55 to F65; E56 to E66; S57 to I67; R58 to E68; L59 to I69; G60 to N70; G61 to G71; T62 to Q72; G63 to L73; A64 to V74; F65 to F75; E66 to S76; I67 to K77; E68 to L78; I69 to E79; N70 to N80; G71 to G81; Q72 to G82; L73 to F83; V74 to P84; F75 to Y85; S76 to E86; K77 to K87; L78 to D88; E79 to L89; N80 to I90; G81 to E91; G82 to A92; F83 to I93; P84 to R94; Y85 to R95; E86 to A96; K87 to S97; D88 to N98; L89 to G99; I90 to E100; E91 to T101; A92 to L102; I93 to E103; R94 to K104; R95 to I105; A96 to T106; S97 to N107; N98 to S108; G99 to R109; E100 to P110; T101 to P111; L102 to C112; E103 to V113; K104 to I114; I105 to L115.

In another preferred embodiment, the isolated polypeptides of the present invention comprising or, alternatively, consisting of, C35 peptide epitopes include the following 12mers (residues correspond to SEQ ID NO:2 and FIG. 1B): M1 to P12; S2 to P13; G3 to P14; E4 to E15; P5 to E16; G6 to V17; Q7 to E18; T8 to P19; S9 to G20; V10 to S21; A11 to G22; P12 to V23; P13 to R24; P14 to I25; E15 to V26; E16 to V27; V17 to E28; E18 to Y29; P19 to C30; G20 to E31; S21 to P32; G22 to C33; V23 to G34; R24 to F35; I25 to E36; V26 to A37; V27 to T38; E28 to Y39; Y29 to L40; C30 to E41; E31 to L42; P32 to A43; C33 to S44; G34 to A45; F35 to V46; E36 to K47; A37 to E48; T38 to Q49; Y39 to Y50; L40 to P51; E41 to G52; L42 to I53; A43 to E54; S44 to I55; A45 to E56; V46 to S57; K47 to R58; E48 to L59; Q49 to G60; Y50 to G61; P51 to T62; G52 to G63; I53 to A64; E54 to F65; I55 to E66; E56 to I67; S57 to E68; R58 to I69; L59 to N70; G60 to G71; G61 to Q72; T62 to L73; G63 to V74; A64 to F75; F65 to S76; E66 to K77; I67 to L78; E68 to E79; I69 to N80; N70 to G81; G71 to G82; Q72 to F83; L73 to P84; V74 to Y85; F75 to E86; S76 to K87; K77 to D88; L78 to L89; E79 to I90; N80 to E91; G81 to A92; G82 to I93; F83 to R94; P84 to R95; Y85 to A96; E86 to S97; K87 to N98; D88 to G99; L89 to E100; I90 to T101; E91 to L102; A92 to E103; I93 to K104; R94 to I105; R95 to T106; A96 to N107; S97 to S108; N98 to R109; G99 to P110; E100 to P111; T101 to C112; L102 to V113; E103 to I114; K104 to L115.

In another preferred embodiment, the isolated polypeptides of the present invention comprising or, alternatively, consisting of, one or more C35 peptide epitopes include the following 13mers (residues correspond to SEQ ID NO:2 and FIG. 1B): M1 to P13; S2 to P14; G3 to E15; E4 to E16; P5 to V17; G6 to E18; Q7 to P19; T8 to G20; S9 to S21; V10 to G22; A11 to V23; P12 to R24; P13 to I25; P14 to V26; E15 to V27; E16 to E28; V17 to Y29; E18 to C30; P19 to E31; G20 to P32; S21 to C33; G22 to G34; V23 to F35; R24 to E36; I25 to A37; V26 to T38; V27 to Y39; E28 to L40; Y29 to E41; C30 to L42; E31 to A43; P32 to S44; C33 to A45; G34 to V46; F35 to K47; E36 to E48; A37 to Q49; T38 to Y50; Y39 to P51; L40 to G52; E41 to I53; L42 to E54; A43 to I55; S44 to E56; A45 to S57; V46 to R58; K47 to L59; E48 to G60; Q49 to G61; Y50 to T62; P51 to G63; G52 to A64; I53 to F65; E54 to E66; I55 to I67; E56 to E68; S57 to I69; R58 to N70; L59 to G71; G60 to Q72; G61 to L73; T62 to V74; G63 to F75; A64 to S76; F65 to K77; E66 to L78; I67 to E79; E68 to N80; I69 to G81; N70 to G82; G71 to F83; Q72 to P84; L73 to Y85; V74 to E86; F75 to K87; S76 to D88; K77 to L89; L78 to I90; E79 to E91; N80 to A92; G81 to I93; G82 to R94; F83 to R95; P84 to A96; Y85 to S97; E86 to N98; K87 to G99; D88 to E100; L89 to T101; I90 to L102; E91 to E103; A92 to K104; I93 to I105; R94 to T106; R95 to N107; A96 to S108; S97 to R109; N98 to P110; G99 to P111; E100 to C112; T101 to V113; L102 to I114; E103 to L115.

In another preferred embodiment, the isolated polypeptides of the present invention comprising or, alternatively, consisting of, one or more C35 peptide epitopes include the following 14mers (residues correspond to SEQ ID NO:2 and FIG. 1B): M1 to P14; S2 to E15; G3 to E16; E4 to V17; P5 to E18; G6 to P19; Q7 to G20; T8 to S21; S9 to G22; V10 to V23; A11 to R24; P12 to I25; P13 to V26; P14 to V27; E15 to E28; E16 to Y29; V17 to C30; E18 to E31; P19 to P32; G20 to C33; S21 to G34; G22 to F35; V23 to E36; R24 to A37; I25 to T38; V26 to Y39; V27 to L40; E28 to E41; Y29 to L42; C30 to A43; E31 to S44; P32 to A45; C33 to V46; G34 to K47; F35 to E48; E36 to Q49; A37 to Y50; T38 to P51; Y39 to G52; L40 to I53; E41 to E54; L42 to I55; A43 to E56; S44 to S57; A45 to R58; V46 to L59; K47 to G60; E48 to G61; Q49 to T62; Y50 to G63; P51 to A64; G52 to F65; I53 to E66; E54 to I67; I55 to E68; E56 to I69; S57 to N70; R58 to G71; L59 to Q72; G60 to L73; G61 to V74; T62 to F75; G63 to S76; A64 to K77; F65 to L78; E66 to E79; I67 to N80; E68 to G81; I69 to G82; N70 to F83; G71 to P84; Q72 to Y85; L73 to E86; V74 to K87; F75 to D88; S76 to L89; K77 to I90; L78 to E91; E79 to A92; N80 to I93; G81 to R94; G82 to R95; F83 to A96; P84 to S97; Y85 to N98; E86 to G99; K87 to E100; D88 to T101; L89 to L102; I90 to E103; E91 to K104; A92 to I105; I93 to T106; R94 to N107; R95 to S108; A96 to R109; S97 to P110; N98 to P111; G99 to C112; E100 to V113; T101 to I114; L102 to L115.

In another preferred embodiment, the isolated polypeptides of the present invention comprising or, alternatively, consisting of, one or more C35 peptide epitopes include the following 15mers (residues correspond to SEQ ID NO:2 and FIG. 1B): M1 to E15; S2 to E16; G3 to V17; E4 to E18; P5 to P19; G6 to G20; Q7 to S21; T8 to G22; S9 to V23; V10 to R24; A11 to I25; P12 to V26; P13 to V27; P14 to E28; E15 to Y29; E16 to C30; V17 to E31; E18 to P32; P19 to C33; G20 to G34; S21 to F35; G22 to E36; V23 to A37; R24 to T38; I25 to Y39; V26 to L40; V27 to E41; E28 to L42; Y29 to A43; C30 to S44; E31 to A45; P32 to V46; C33 to K47; G34 to E48; F35 to Q49; E36 to Y50; A37 to P51; T38 to G52; Y39 to I53; L40 to E54; E41 to I55; L42 to E56; A43 to S57; S44 to R58; A45 to L59; V46 to G60; K47 to G61; E48 to T62; Q49 to G63; Y50 to A64; P51 to F65; G52 to E66; I53 to I67; E54 to E68; I55 to I69; E56 to N70; S57 to G71; R58 to Q72; L59 to L73; G60 to V74; G61 to F75; T62 to S76; G63 to K77; A64 to L78; F65 to E79; E66 to N80; I67 to G81; E68 to G82; I69 to F83; N70 to P84; G71 to Y85; Q72 to E86; L73 to K87; V74 to D88; F75 to L89; S76 to I90; K77 to E91; L78 to A92; E79 to I93; N80 to R94; G81 to R95; G82 to A96; F83 to S97; P84 to N98; Y85 to G99; E86 to E100; K87 to T101; D88 to L102; L89 to E103; I90 to K104; E91 to I105; A92 to T106; I93 to N107; R94 to S108; R95 to R109; A96 to P110; S97 to P111; N98 to C112; G99 to V113; E100 to I114; T101 to L115.

In a further preferred embodiment, the isolated polypeptides of the present invention comprising or, alternatively, consisting of, one or more C35 peptide epitopes include the following 16mers (residues correspond to SEQ ID NO:2 and FIG. 1B): M1 to E16; S2 to V17; G3 to E18; E4 to P19; P5 to G20; G6 to S21; Q7 to G22; T8 to V23; S9 to R24; V10 to I25; A11 to V26; P12 to V27; P13 to E28; P14 to Y29; E15 to C30; E16 to E31; V17 to P32; E18 to C33; P19 to G34; G20 to F35; S21 to E36; G22 to A37; V23 to T38; R24 to Y39; I25 to L40; V26 to E41; V27 to L42; E28 to A43; Y29 to S44; C30 to A45; E31 to V46; P32 to K47; C33 to E48; G34 to Q49; F35 to Y50; E36 to P51; A37 to G52; T38 to I53; Y39 to E54; L40 to I55; E41 to E56; L42 to S57; A43 to R58; S44 to L59; A45 to G60; V46 to G61; K47 to T62; E48 to G63; Q49 to A64; Y50 to F65; P51 to E66; G52 to I67; I53 to E68; E54 to I69; I55 to N70; E56 to G71; S57 to Q72; R58 to L73; L59 to V74; G60 to F75; G61 to S76; T62 to K77; G63 to L78; A64 to E79; F65 to N80; E66 to G81; I67 to G82; E68 to F83; I69 to P84; N70 to Y85; G71 to E86; Q72 to K87; L73 to D88; V74 to L89; F75 to I90; S76 to E91; K77 to A92; L78 to I93; E79 to R94; N80 to R95; G81 to A96; G82 to S97; F83 to N98; P84 to G99; Y85 to E100; E86 to T101; K87 to L102; D88 to E103; L89 to K104; I90 to I105; E91 to T106; A92 to N107; I93 to S108; R94 to R109; R95 to P110; A96 to P111; S97 to C112; N98 to V113; G99 to I114; E100 to L115.

In another preferred embodiment, the isolated polypeptides of the present invention comprising or, alternatively, consisting of, one or more C35 peptide epitopes include the following 17mers: M1 to V17; S2 to E18; G3 to P19; E4 to G20; P5 to S21; G6 to G22; Q7 to V23; T8 to R24; S9 to I25; V10 to V26; A11 to V27; P12 to E28; P13 to Y29; P14 to C30; E15 to E31; E16 to P32; V17 to C33; E18 to G34; P19 to F35; G20 to E36; S21 to A37; G22 to T38; V23 to Y39; R24 to L40; I25 to E41; V26 to L42; V27 to A43; E28 to S44; Y29 to A45; C30 to V46; E31 to K47; P32 to E48; C33 to Q49; G34 to Y50; F35 to P51; E36 to G52; A37 to I53; T38 to E54; Y39 to I55; L40 to E56; E41 to S57; L42 to R58; A43 to L59; S44 to G60; A45 to G61; V46 to T62; K47 to G63; E48 to A64; Q49 to F65; Y50 to E66; P51 to I67; G52 to E68; I53 to I69; E54 to N70; I55 to G71; E56 to Q72; S57 to L73; R58 to V74; L59 to F75; G60 to S76; G61 to K77; T62 to L78; G63 to E79; A64 to N80; F65 to G81; E66 to G82; I67 to F83; E68 to P84; I69 to Y85; N70 to E86; G71 to K87; Q72 to D88; L73 to L89; V74 to I90; F75 to E91; S76 to A92; K77 to I93; L78 to R94; E79 to R95; N80 to A96; G81 to S97; G82 to N98; F83 to G99; P84 to E100; Y85 to T101; E86 to L102; K87 to E103; D88 to K104; L89 to I105; I90 to T106; E91 to N107; A92 to S108; I93 to R109; R94 to P110; R95 to P111; A96 to C112; S97 to V113; N98 to I114; G99 to L115.

In another preferred embodiment, the isolated polypeptides of the present invention comprising or, alternatively, consisting of, one or more C35 peptide epitopes include the following 18mers (residues correspond to SEQ ID NO:2 and FIG. 1B): M1 to E18; S2 to P19; G3 to G20; E4 to S21; P5 to G22; G6 to V23; Q7 to R24; T8 to I25; S9 to V26; V10 to V27; A11 to E28; P12 to Y29; P13 to C30; P14 to E31; E15 to P32; E16 to C33; V17 to G34; E18 to F35; P19 to E36; G20 to A37; S21 to T38; G22 to Y39; V23 to L40; R24 to E41; I25 to L42; V26 to A43; V27 to S44; E28 to A45; Y29 to V46; C30 to K47; E31 to E48; P32 to Q49; C33 to Y50; G34 to P51; F35 to G52; E36 to I53; A37 to E54; T38 to I55; Y39 to E56; L40 to S57; E41 to R58; L42 to L59; A43 to G60; S44 to G61; A45 to T62; V46 to G63; K47 to A64; E48 to F65; Q49 to E66; Y50 to I67;

P51 to E68; G52 to I69; I53 to N70; E54 to G71; I55 to Q72; E56 to L73; S57 to V74; R58 to F75; L59 to S76; G60 to K77; G61 to L78; T62 to E79; G63 to N80; A64 to G81; F65 to G82; E66 to F83; I67 to P84; E68 to Y85; I69 to E86; N70 to K87; G71 to D88; Q72 to L89; L73 to I90; V74 to E91; F75 to A92; S76 to I93; K77 to R94; L78 to R95; E79 to A96; N80 to S97; G81 to N98; G82 to G99; F83 to E100; P84 to T101; Y85 to L102; E86 to E103; K87 to K104; D88 to I105; L89 to T106; I90 to N107; E91 to S108; A92 to R109; I93 to P110; R94 to P111; R95 to C112; A96 to V113; S97 to I114; N98 to L115.

In another preferred embodiment, the isolated polypeptides of the present invention comprising or, alternatively, consisting of, one or more C35 peptide epitopes include the following 19mers (residues correspond to SEQ ID NO:2 and FIG. 1B): M1 to P19; S2 to G20; G3 to S21; E4 to G22; P5 to V23; G6 to R24; Q7 to I25; T8 to V26; S9 to V27; V10 to E28; A11 to Y29; P12 to C30; P13 to E31; P14 to P32; E15 to C33; E16 to G34; V17 to F35; E18 to E36; P19 to A37; G20 to T38; S21 to Y39; G22 to L40; V23 to E41; R24 to L42; I25 to A43; V26 to S44; V27 to A45; E28 to V46; Y29 to K47; C30 to E48; E31 to Q49; P32 to Y50; C33 to P51; G34 to G52; F35 to I53; E36 to E54; A37 to I55; T38 to E56; Y39 to S57; L40 to R58; E41 to L59; L42 to G60; A43 to G61; S44 to T62; A45 to G63; V46 to A64; K47 to F65; E48 to E66; Q49 to I67; Y50 to E68; P51 to I69; G52 to N70; I53 to G71; E54 to Q72; I55 to L73; E56 to V74; S57 to F75; R58 to S76; L59 to K77; G60 to L78; G61 to E79; T62 to N80; G63 to G81; A64 to G82; F65 to F83; E66 to P84; I67 to Y85; E68 to E86; I69 to K87; N70 to D88; G71 to L89; Q72 to I90; L73 to E91; V74 to A92; F75 to I93; S76 to R94; K77 to R95; L78 to A96; E79 to S97; N80 to N98; G81 to G99; G82 to E100; F83 to T101; P84 to L102; Y85 to E103; E86 to K104; K87 to I105; D88 to T106; L89 to N107; I90 to S108; E91 to R109; A92 to P110; I93 to P111; R94 to C112; R95 to V113; A96 to I114; S97 to L115.

In another preferred embodiment, the isolated polypeptides of the present invention comprising or, alternatively, consisting of, one or more C35 peptide epitopes include the following 20mers (residues correspond to SEQ ID NO:2 and FIG. 1B): M1 to G20; S2 to S21; G3 to G22; E4 to V23; P5 to R24; G6 to I25; Q7 to V26; T8 to V27; S9 to E28; V10 to Y29; A11 to C30; P12 to E31; P13 to P32; P14 to C33; E15 to G34; E16 to F35; V17 to E36; E18 to A37; P19 to T38; G20 to Y39; S21 to L40; G22 to E41; V23 to L42; R24 to A43; I25 to S44; V26 to A45; V27 to V46; E28 to K47; Y29 to E48; C30 to Q49; E31 to Y50; P32 to P51; C33 to G52; G34 to I53; F35 to E54; E36 to I55; A37 to E56; T38 to S57; Y39 to R58; L40 to L59; E41 to G60; L42 to G61; A43 to T62; S44 to G63; A45 to A64; V46 to F65; K47 to E66; E48 to I67; Q49 to E68; Y50 to I69; P51 to N70; G52 to G71; I53 to Q72; E54 to L73; I55 to V74; E56 to F75; S57 to S76; R58 to K77; L59 to L78; G60 to E79; G61 to N80; T62 to G81; G63 to G82; A64 to F83; F65 to P84; E66 to Y85; I67 to E86; E68 to K87; I69 to D88; N70 to L89; G71 to I90; Q72 to E91; L73 to A92; V74 to I93; F75 to R94; S76 to R95; K77 to A96; L78 to S97; E79 to N98; N80 to G99; G81 to E100; G82 to T101; F83 to L102; P84 to E103; Y85 to K104; E86 to I105; K87 to T106; D88 to N107; L89 to S108; I90 to R109; E91 to P110; A92 to P111; I93 to C112; R94 to V113; R95 to I114; A96 to L115.

In another preferred embodiment, the isolated polypeptides of the present invention comprising or, alternatively, consisting of, one or more C35 peptide epitopes include the following 21mers (residues correspond to SEQ ID NO:2 and FIG. 1B): M1 to S21; S2 to G22; G3 to V23; E4 to R24; P5 to I25; G6 to V26; Q7 to V27; T8 to E28; S9 to Y29; V10 to C30; A11 to E31; P12 to P32; P13 to C33; P14 to G34; E15 to F35; E16 to E36; V17 to A37; E18 to T38; P19 to Y39; G20 to L40; S21 to E41; G22 to L42; V23 to A43; R24 to S44; I25 to A45; V26 to V46; V27 to K47; E28 to E48; Y29 to Q49; C30 to Y50; E31 to P51; P32 to G52; C33 to I53; G34 to E54; F35 to I55; E36 to E56; A37 to S57; T38 to R58; Y39 to L59; L40 to G60; E41 to G61; L42 to T62; A43 to G63; S44 to A64; A45 to F65; V46 to E66; K47 to I67; E48 to E68; Q49 to I69; Y50 to N70; P51 to G71; G52 to Q72; I53 to L73; E54 to V74; I55 to F75; E56 to S76; S57 to K77; R58 to L78; L59 to E79; G60 to N80; G61 to G81; T62 to G82; G63 to F83; A64 to P84; F65 to Y85; E66 to E86; I67 to K87; E68 to D88; I69 to L89; N70 to I90; G71 to E91; Q72 to A92; L73 to I93; V74 to R94; F75 to R95; S76 to A96; K77 to S97; L78 to N98; E79 to G99; N80 to E100; G81 to T101; G82 to L102; F83 to E103; P84 to K104; Y85 to I105; E86 to T106; K87 to N107; D88 to S108; L89 to R109; I90 to P110; E91 to P111; A92 to C112; I93 to V113; R94 to I114; R95 to L115.

In another preferred embodiment, the isolated polypeptides of the present invention comprising or, alternatively, consisting of, one or more C35 peptide epitopes include the following 22mers (residues correspond to SEQ ID NO:2 and FIG. 1B): M1 to G22; S2 to V23; G3 to R24; E4 to I25; P5 to V26; G6 to V27; Q7 to E28; T8 to Y29; S9 to C30; V10 to E31; A11 to P32; P12 to C33; P13 to G34; P14 to F35; E15 to E36; E16 to A37; V17 to T38; E18 to Y39; P19 to L40; G20 to E41; S21 to L42; G22 to A43; V23 to S44; R24 to A45; I25 to V46; V26 to K47; V27 to E48; E28 to Q49; Y29 to Y50; C30 to P51; E31 to G52; P32 to I53; C33 to E54; G34 to I55; F35 to E56; E36 to S57; A37 to R58; T38 to L59; Y39 to G60; L40 to G61; E41 to T62; L42 to G63; A43 to A64; S44 to F65; A45 to E66; V46 to I67; K47 to E68; E48 to I69; Q49 to N70; Y50 to G71; P51 to Q72; G52 to L73; I53 to V74; E54 to F75; I55 to S76; E56 to K77; S57 to L78; R58 to E79; L59 to N80; G60 to G81; G61 to G82; T62 to F83; G63 to P84; A64 to Y85; F65 to E86; E66 to K87; I67 to D88; E68 to L89; I69 to I90; N70 to E91; G71 to A92; Q72 to I93; L73 to R94; V74 to R95; F75 to A96; S76 to S97; K77 to N98; L78 to G99; E79 to E100; N80 to T101; G81 to L102; G82 to E103; F83 to K104; P84 to I105; Y85 to T106; E86 to N107; K87 to S108; D88 to R109; L89 to P110; I90 to P111; E91 to C112; A92 to V113; I93 to I114; R94 to L115.

In another preferred embodiment, the isolated polypeptides of the present invention comprising or, alternatively, consisting of, one or more C35 peptide epitopes include the following 23mers (residues correspond to SEQ ID NO:2 and FIG. 1B): M1 to V23; S2 to R24; G3 to I25; E4 to V26; P5 to V27; G6 to E28; Q7 to Y29; T8 to C30; S9 to E31; V10 to P32; A11 to C33; P12 to G34; P13 to F35; P14 to E36; E15 to A37; E16 to T38; V17 to Y39; E18 to L40; P19 to E41; G20 to L42; S21 to A43; G22 to S44; V23 to A45; R24 to V46; I25 to K47; V26 to E48; V27 to Q49; E28 to Y50; Y29 to P51; C30 to G52; E31 to I53; P32 to E54; C33 to I55; G34 to E56; F35 to S57; E36 to R58; A37 to L59; T38 to G60; Y39 to G61; L40 to T62; E41 to G63; L42 to A64; A43 to F65; S44 to E66; A45 to I67; V46 to E68; K47 to I69; E48 to N70; Q49 to G71; Y50 to Q72; P51 to L73; G52 to V74; I53 to F75; E54 to S76; I55 to K77; E56 to L78; S57 to E79; R58 to N80; L59 to G81; G60 to G82; G61 to F83; T62 to P84; G63 to Y85; A64 to E86; F65 to K87; E66 to D88; I67 to L89; E68 to I90; I69 to E91; N70 to A92; G71 to I93; Q72 to R94; L73 to R95; V74 to A96; F75 to S97; S76 to N98; K77 to G99; L78 to E100; E79 to T101; N80 to L102; G81 to E103; G82 to K104; F83 to I105; P84 to T106; Y85 to N107; E86 to S108; K87 to R109; D88 to P110; L89 to P111; I90 to C112; E91 to V113; A92 to I114; I93 to L115.

In another preferred embodiment, the isolated polypeptides of the present invention comprising or, alternatively, consisting of, one or more C35 peptide epitopes include the following 24mers (residues correspond to SEQ ID NO:2 and FIG. 1B): M1 to R24; S2 to I25; G3 to V26; E4 to V27; P5 to E28; G6 to Y29; Q7 to C30; T8 to E31; S9 to P32; V10 to C33; A11 to G34; P12 to F35; P13 to E36; P14 to A37; E15 to T38; E16 to Y39; V17 to L40; E18 to E41; P19 to L42; G20 to A43; S21 to S44; G22 to A45; V23 to V46; R24 to K47; I25 to E48; V26 to Q49; V27 to Y50; E28 to P51; Y29 to G52; C30 to I53; E31 to E54; P32 to I55; C33 to E56; G34 to S57; F35 to R58; E36 to L59; A37 to G60; T38 to G61; Y39 to T62; L40 to G63; E41 to A64; L42 to F65; A43 to E66; S44 to I67; A45 to E68; V46 to I69; K47 to N70; E48 to G71; Q49 to Q72; Y50 to L73; P51 to V74; G52 to F75; I53 to S76; E54 to K77; I55 to L78; E56 to E79; S57 to N80; R58 to G81; L59 to G82; G60 to F83; G61 to P84; T62 to Y85; G63 to E86; A64 to K87; F65 to D88; E66 to L89; I67 to I90; E68 to E91; I69 to A92; N70 to I93; G71 to R94; Q72 to R95; L73 to A96; V74 to S97; F75 to N98; S76 to G99; K77 to E100; L78 to T101; E79 to L102; N80 to E103; G81 to K104; G82 to I105; F83 to T106; P84 to N107; Y85 to S108; E86 to R109; K87 to P110; D88 to P111; L89 to C112; I90 to V113; E91 to I114; A92 to L115.

In another preferred embodiment, the isolated polypeptides of the present invention comprising or, alternatively, consisting of, one or more C35 peptide epitopes include the following 25mers (residues correspond to SEQ ID NO:2 and FIG. 1B): M1 to I25; S2 to V26; G3 to V27; E4 to E28; P5 to Y29; G6 to C30; Q7 to E31; T8 to P32; S9 to C33; V10 to G34; A11 to F35; P12 to E36; P13 to A37; P14 to T38; E15 to Y39; E16 to L40; V17 to E41; E18 to L42; P19 to A43; G20 to S44; S21 to A45; G22 to V46; V23 to K47; R24 to E48; I25 to Q49; V26 to Y50; V27 to P51; E28 to G52; Y29 to I53; C30 to E54; E31 to I55; P32 to E56; C33 to S57; G34 to R58; F35 to L59; E36 to G60; A37 to G61; T38 to T62; Y39 to G63; L40 to A64; E41 to F65; L42 to E66; A43 to I67; S44 to E68; A45 to I69; V46 to N70; K47 to G71; E48 to Q72; Q49 to L73; Y50 to V74; P51 to F75; G52 to S76; I53 to K77; E54 to L78; I55 to E79; E56 to N80; S57 to G81; R58 to G82; L59 to F83; G60 to P84; G61 to Y85; T62 to E86; G63 to K87; A64 to D88; F65 to L89; E66 to I90; I67 to E91; E68 to A92; I69 to I93; N70 to R94; G71 to R95; Q72 to A96; L73 to S97; V74 to N98; F75 to G99; S76 to E100; K77 to T101; L78 to L102; E79 to E103; N80 to K104; G81 to I105; G82 to T106; F83 to N107; P84 to S108; Y85 to R109; E86 to P110; K87 to P111; D88 to C112; L89 to V113; I90 to I114; E91 to L115.

In another preferred embodiment, the isolated polypeptides of the present invention comprising or, alternatively, consisting of, one or more C35 peptide epitopes include the following 26mers (residues correspond to SEQ ID NO:2 and FIG. 1B): M1 to V26; S2 to V27; G3 to E28; E4 to Y29; P5 to C30; G6 to E31; Q7 to P32; T8 to C33; S9 to G34; V10 to F35; A11 to E36; P12 to A37; P13 to T38; P14 to Y39; E15 to L40; E16 to E41; V17 to L42; E18 to A43; P19 to S44; G20 to A45; S21 to V46; G22 to K47; V23 to E48; R24 to Q49; I25 to Y50; V26 to P51; V27 to G52; E28 to I53; Y29 to E54; C30 to I55; E31 to E56; P32 to S57; C33 to R58; G34 to L59; F35 to G60; E36 to G61; A37 to T62; T38 to G63; Y39 to A64; L40 to F65; E41 to E66; L42 to I67; A43 to E68; S44 to I69; A45 to N70; V46 to G71; K47 to Q72; E48 to L73; Q49 to V74; Y50 to F75; P51 to S76; G52 to K77; I53 to L78; E54 to E79; I55 to N80; E56 to G81; S57 to G82; R58 to F83; L59 to P84; G60 to Y85; G61 to E86; T62 to K87; G63 to D88; A64 to L89; F65 to I90; E66 to E91; I67 to A92; E68 to I93; I69 to R94; N70 to R95; G71 to A96; Q72 to S97; L73 to N98; V74 to G99; F75 to E100; S76 to T101; K77 to L102; L78 to E103; E79 to K104; N80 to I105; G81 to T106; G82 to N107; F83 to S108; P84 to R109; Y85 to P110; E86 to P111; K87 to C112; D88 to V113; L89 to I114; I90 to L115.

In another preferred embodiment, the isolated polypeptides of the present invention comprising or, alternatively, consisting of, one or more C35 peptide epitopes include the following 27mers (residues correspond to SEQ ID NO:2 and FIG. 1B): M1 to V27; S2 to E28; G3 to Y29; E4 to C30; P5 to E31; G6 to P32; Q7 to C33; T8 to G34; S9 to F35; V10 to E36; A11 to A37; P12 to T38; P13 to Y39; P14 to L40; E15 to E41; E16 to L42; V17 to A43; E18 to S44; P19 to A45; G20 to V46; S21 to K47; G22 to E48; V23 to Q49; R24 to Y50; I25 to P51; V26 to G52; V27 to I53; E28 to E54; Y29 to I55; C30 to E56; E31 to S57; P32 to R58; C33 to L59; G34 to G60; F35 to G61; E36 to T62; A37 to G63; T38 to A64; Y39 to F65; L40 to E66; E41 to I67; L42 to E68; A43 to I69; S44 to N70; A45 to G71; V46 to Q72; K47 to L73; E48 to V74; Q49 to F75; Y50 to S76; P51 to K77; G52 to L78; I53 to E79; E54 to N80; I55 to G81; E56 to G82; S57 to F83; R58 to P84; L59 to Y85; G60 to E86; G61 to K87; T62 to D88; G63 to L89; A64 to I90; F65 to E91; E66 to A92; I67 to I93; E68 to R94; I69 to R95; N70 to A96; G71 to S97; Q72 to N98; L73 to G99; V74 to E100; F75 to T101; S76 to L102; K77 to E103; L78 to K104; E79 to I105; N80 to T106; G81 to N107; G82 to S108; F83 to R109; P84 to P110; Y85 to P111; E86 to C112; K87 to V113; D88 to I114; L89 to L115.

In another preferred embodiment, the isolated polypeptides of the present invention comprising or, alternatively, consisting of, one or more C35 peptide epitopes include the following 28mers (residues correspond to SEQ ID NO:2 and FIG. 1B): M1 to E28; S2 to Y29; G3 to C30; E4 to E31; P5 to P32; G6 to C33; Q7 to G34; T8 to F35; S9 to E36; V10 to A37; A11 to T38; P12 to Y39; P13 to L40; P14 to E41; E15 to L42; E16 to A43; V17 to S44; E18 to A45; P19 to V46; G20 to K47; S21 to E48; G22 to Q49; V23 to Y50; R24 to P51; I25 to G52; V26 to I53; V27 to E54; E28 to I55; Y29 to E56; C30 to S57; E31 to R58; P32 to L59; C33 to G60; G34 to G61; F35 to T62; E36 to G63; A37 to A64; T38 to F65; Y39 to E66; L40 to I67; E41 to E68; L42 to I69; A43 to N70; S44 to G71; A45 to Q72; V46 to L73; K47 to V74; E48 to F75; Q49 to S76; Y50 to K77; P51 to L78; G52 to E79; I53 to N80; E54 to G81; I55 to G82; E56 to F83; S57 to P84; R58 to Y85; L59 to E86; G60 to K87; G61 to D88; T62 to L89; G63 to I90; A64 to E91; F65 to A92; E66 to I93; I67 to R94; E68 to R95; I69 to A96; N70 to S97; G71 to N98; Q72 to G99; L73 to E100; V74 to T101; F75 to L102; S76 to E103; K77 to K104; L78 to I105; E79 to T106; N80 to N107; G81 to S108; G82 to R109; F83 to P110; P84 to P111; Y85 to C112; E86 to V113; K87 to I114; D88 to L115.

In another preferred embodiment, the isolated polypeptides of the present invention comprising or, alternatively, consisting of, one or more C35 peptide epitopes include the following 29mers (residues correspond to SEQ ID NO:2 and FIG. 1B): M1 to Y29; S2 to C30; G3 to E31; E4 to P32; P5 to C33; G6 to G34; Q7 to F35; T8 to E36; S9 to A37; V10 to T38; A11 to Y39; P12 to L40; P13 to E41; P14 to L42; E15 to A43; E16 to S44; V17 to A45; E18 to V46; P19 to K47; G20 to E48; S21 to Q49; G22 to Y50; V23 to P51; R24 to G52; I25 to I53; V26 to E54; V27 to I55; E28 to E56; Y29 to S57; C30 to R58; E31 to L59; P32 to G60; C33 to G61; G34 to T62; F35 to G63; E36 to A64; A37 to F65; T38 to E66; Y39 to I67; L40 to E68; E41 to I69; L42 to N70; A43 to G71; S44 to Q72; A45 to L73; V46 to V74; K47 to F75; E48 to S76; Q49 to K77; Y50 to L78; P51 to E79; G52 to N80; I53 to G81; E54 to G82; I55 to F83; E56 to P84; S57 to Y85; R58 to E86; L59 to K87; G60 to D88; G61 to L89; T62 to I90; G63 to E91; A64 to A92; F65 to I93; E66 to R94; I67 to R95; E68 to A96; I69 to S97; N70 to N98; G71 to G99; Q72 to E100; L73 to T101; V74 to L102; F75 to E103; S76 to K104; K77 to I105; L78 to T106; E79 to N107; N80 to S108; G81 to R109; G82 to P110; F83 to P111; P84 to C112; Y85 to V113; E86 to I114; K87 to L115.

In another preferred embodiment, the isolated polypeptides of the present invention comprising or, alternatively, consisting of, one or more C35 peptide epitopes include the following 30mers (residues correspond to SEQ ID NO:2 and FIG. 1B): M1 to C30; S2 to E31; G3 to P32; E4 to C33; P5 to G34; G6 to F35; Q7 to E36; T8 to A37; S9 to T38; V10 to Y39; A11 to L40; P12 to E41; P13 to L42; P14 to A43; E15 to S44; E16 to A45; V17 to V46; E18 to K47; P19 to E48; G20 to Q49; S21 to Y50; G22 to P51; V23 to G52; R24 to I53; I25 to E54; V26 to I55; V27 to E56; E28 to S57; Y29 to R58; C30 to L59; E31 to G60; P32 to G61; C33 to T62; G34 to G63; F35 to A64; E36 to F65; A37 to E66; T38 to I67; Y39 to E68; L40 to I69; E41 to N70; L42 to G71; A43 to Q72; S44 to L73; A45 to V74; V46 to F75; K47 to S76; E48 to K77; Q49 to L78; Y50 to E79; P51 to N80; G52 to G81; I53 to G82; E54 to F83; I55 to P84; E56 to Y85; S57 to E86; R58 to K87; L59 to D88; G60 to L89; G61 to I90; T62 to E91; G63 to A92; A64 to I93; F65 to R94; E66 to R95; I67 to A96; E68 to S97; I69 to N98; N70 to G99; G71 to E100; Q72 to T101; L73 to L102; V74 to E103; F75 to K104; S76 to I105; K77 to T106; L78 to N107; E79 to S108; N80 to R109; G81 to P110; G82 to P111; F83 to C112; P84 to V113; Y85 to I114; E86 to L115.

In another preferred embodiment, the isolated polypeptides of the present invention comprising or, alternatively, consisting of, one or more C35 peptide epitopes include the following 31mers (residues correspond to SEQ ID NO:2 and FIG. 1B): M1 to E31; S2 to P32; G3 to C33; E4 to G34; P5 to F35; G6 to E36; Q7 to A37; T8 to T38; S9 to Y39; V10 to L40; A11 to E41; P12 to L42; P13 to A43; P14 to S44; E15 to A45; E16 to V46; V17 to K47; E18 to E48; P19 to Q49; G20 to Y50; S21 to P51; G22 to G52; V23 to I53; R24 to E54; I25 to I55; V26 to E56; V27 to S57; E28 to R58; Y29 to L59; C30 to G60; E31 to G61; P32 to T62; C33 to G63; G34 to A64; F35 to F65; E36 to E66; A37 to I67; T38 to E68; Y39 to I69; L40 to N70; E41 to G71; L42 to Q72; A43 to L73; S44 to V74; A45 to F75; V46 to S76; K47 to K77; E48 to L78; Q49 to E79; Y50 to N80; P51 to G81; G52 to G82; I53 to F83; E54 to P84; I55 to Y85; E56 to E86; S57 to K87; R58 to D88; L59 to L89; G60 to I90; G61 to E91; T62 to A92; G63 to I93; A64 to R94; F65 to R95; E66 to A96; I67 to S97; E68 to N98; I69 to G99; N70 to E100; G71 to T101; Q72 to L102; L73 to E103; V74 to K104; F75 to I105; S76 to T106; K77 to N107; L78 to S108; E79 to R109; N80 to P110; G81 to P111; G82 to C112; F83 to V113; P84 to I114 and Y85 to L115.

In another preferred embodiment, the isolated polypeptides of the present invention comprising or, alternatively, consisting of, one or more C35 peptide epitopes include the following 32mers (residues correspond to SEQ ID NO:2 and FIG. 1B): M1 to P32; S2 to C33; G3 to G34; E4 to F35; P5 to E36; G6 to A37; Q7 to T38; T8 to Y39; S9 to L40; V10 to E41; A11 to L42; P12 to A43; P13 to S44; P14 to A45; E15 to V46; E16 to K47; V17 to E48; E18 to Q49; P19 to Y50; G20 to P51; S21 to G52; G22 to I53; V23 to E54; R24 to I55; I25 to E56; V26 to S57; V27 to R58; E28 to L59; Y29 to G60; C30 to G61; E31 to T62; P32 to G63; C33 to A64; G34 to F65; F35 to E66; E36 to I67; A37 to E68; T38 to I69; Y39 to N70; L40 to G71; E41 to Q72; L42 to L73; A43 to V74; S44 to F75; A45 to S76; V46 to K77; K47 to L78; E48 to E79; Q49 to N80; Y50 to G81; P51 to G82; G52 to F83; I53 to P84; E54 to Y85; I55 to E86; E56 to K87; S57 to D88; R58 to L89; L59 to I90; G60 to E91; G61 to A92; T62 to I93; G63 to R94; A64 to R95; F65 to A96; E66 to S97; I67 to N98; E68 to G99; I69 to E100; N70 to T101; G71 to L102; Q72 to E103; L73 to K104; V74 to I105; F75 to T106; S76 to N107; K77 to S108; L78 to R109; E79 to P110; N80 to P111; G81 to C112; G82 to V113; F83 to I114 and P84 to L115.

In another preferred embodiment, the isolated polypeptides of the present invention comprising or, alternatively, consisting of, one or more C35 peptide epitopes include the following 33mers (residues correspond to SEQ ID NO:2 and FIG. 1B): M1 to C33; S2 to G34; G3 to F35; E4 to E36; P5 to A37; G6 to T38; Q7 to Y39; T8 to L40; S9 to E41; V10 to L42; A11 to A43; P12 to S44; P13 to A45; P14 to V46; E15 to K47; E16 to E48; V17 to Q49; E18 to Y50; P19 to P51; G20 to G52; S21 to I53; G22 to E54; V23 to I55; R24 to E56; I25 to S57; V26 to R58; V27 to L59; E28 to G60; Y29 to G61; C30 to T62; E31 to G63; P32 to A64; C33 to F65; G34 to E66; F35 to I67; E36 to E68; A37 to I69; T38 to N70; Y39 to G71; L40 to Q72; E41 to L73; L42 to V74; A43 to F75; S44 to S76; A45 to K77; V46 to L78; K47 to E79; E48 to N80; Q49 to G81; Y50 to G82; P51 to F83; G52 to P84; I53 to Y85; E54 to E86; I55 to K87; E56 to D88; S57 to L89; R58 to I90; L59 to E91; G60 to A92; G61 to I93; T62 to R94; G63 to R95; A64 to A96; F65 to S97; E66 to N98; I67 to G99; E68 to E100; I69 to T101; N70 to L102; G71 to E103; Q72 to K104; L73 to I105; V74 to T106; F75 to N107; S76 to S108; K77 to R109; L78 to P110; E79 to P111; N80 to C112; G81 to V113; G82 to I114 and F83 to L115.

In another preferred embodiment, the isolated polypeptides of the present invention comprising or, alternatively, consisting of, one or more C35 peptide epitopes include the following 34mers (residues correspond to SEQ ID NO:2 and FIG. 1B): M1 to G34; S2 to F35; G3 to E36; E4 to A37; P5 to T38; G6 to Y39; Q7 to L40; T8 to E41; S9 to L42; V10 to A43; A11 to S44; P12 to A45; P13 to V46; P14 to K47; E15 to E48; E16 to Q49; V17 to Y50; E18 to P51; P19 to G52; G20 to I53; S21 to E54; G22 to I55; V23 to E56; R24 to S57; I25 to R58; V26 to L59; V27 to G60; E28 to G61; Y29 to T62; C30 to G63; E31 to A64; P32 to F65; C33 to E66; G34 to I67; F35 to E68; E36 to I69; A37 to N70; T38 to G71; Y39 to Q72; L40 to L73; E41 to V74; L42 to F75; A43 to S76; S44 to K77; A45 to L78; V46 to E79; K47 to N80; E48 to G81; Q49 to G82; Y50 to F83; P51 to P84; G52 to Y85; I53 to E86; E54 to K87; I55 to D88; E56 to L89; S57 to I90; R58 to E91; L59 to A92; G60 to I93; G61 to R94; T62 to R95; G63 to A96; A64 to S97; F65 to N98; E66 to G99; I67 to E100; E68 to T101; I69 to L102; N70 to E103; G71 to K104; Q72 to I105; L73 to T106; V74 to N107; F75 to S108; S76 to R109; K77 to P110; L78 to P111; E79 to C112; N80 to V113; G81 to I114 and G82 to L115.

In another preferred embodiment, the isolated polypeptides of the present invention comprising or, alternatively, consisting of, one or more C35 peptide epitopes include the following 35mers (residues correspond to SEQ ID NO:2 and FIG. 1B): M1 to F35; S2 to E36; G3 to A37; E4 to T38; P5 to Y39; G6 to L40; Q7 to E41; T8 to L42; S9 to A43; V10 to S44; A11 to A45; P12 to V46; P13 to K47; P14 to E48; E15 to Q49; E16 to Y50; V17 to P51; E18 to G52; P19 to I53; G20 to E54; S21 to I55; G22 to E56; V23 to S57; R24 to R58; I25 to L59; V26 to G60; V27 to G61; E28 to T62; Y29 to G63; C30 to A64; E31 to F65; P32 to E66; C33 to I67; G34 to E68; F35 to I69; E36 to N70; A37 to G71; T38 to Q72; Y39 to L73; L40 to V74; E41 to F75; L42 to S76; A43 to K77; S44 to L78; A45 to E79; V46 to N80; K47 to G81; E48 to G82; Q49 to F83; Y50 to P84; P51 to Y85; G52 to E86; I53 to K87; E54 to D88; I55 to L89; E56 to I90; S57 to E91; R58 to A92; L59 to I93; G60 to R94; G61 to R95; T62 to A96; G63 to S97; A64 to N98; F65 to G99; E66 to E100; I67 to T101; E68 to L102; I69 to E103; N70 to K104; G71 to I105; Q72 to T106; L73 to N107; V74 to S108; F75 to R109; S76 to P110; K77 to P111; L78 to C112; E79 to V113; N80 to I114; G81 to L115.

In another preferred embodiment, the isolated polypeptides of the present invention comprising or, alternatively, consisting of, one or more C35 peptide epitopes include the following 36mers (residues correspond to SEQ ID NO:2 and FIG. 1B):

M1 to E36; S2 to A37; G3 to T38; E4 to Y39; P5 to L40; G6 to E41; Q7 to L42; T8 to A43; S9 to S44; V10 to A45; A11 to V46; P12 to K47; P13 to E48; P14 to Q49; E15 to Y50; E16 to P51; V17 to G52; E18 to I53; P19 to E54; G20 to I55; S21 to E56; G22 to S57; V23 to R58; R24 to L59; I25 to G60; V26 to G61; V27 to T62; E28 to G63; Y29 to A64; C30 to F65; E31 to E66; P32 to I67; C33 to E68; G34 to I69; F35 to N70; E36 to G71; A37 to Q72; T38 to L73; Y39 to V74; L40 to F75; E41 to S76; L42 to K77; A43 to L78; S44 to E79; A45 to N80; V46 to G81; K47 to G82; E48 to F83; Q49 to P84; Y50 to Y85; P51 to E86; G52 to K87; I53 to D88; E54 to L89; I55 to I90; E56 to E91; S57 to A92; R58 to I93; L59 to R94; G60 to R95; G61 to A96; T62 to S97; G63 to N98; A64 to G99; F65 to E100; E66 to T101; I67 to L102; E68 to E103; I69 to K104; N70 to I105; G71 to T106; Q72 to N107; L73 to S108; V74 to R109; F75 to P110; S76 to P111; K77 to C112; L78 to V113; E79 to I114; N80 to L115.

In another preferred embodiment, the isolated polypeptides of the present invention comprising or, alternatively, consisting of, one or more C35 peptide epitopes include the following 37mers (residues correspond to SEQ ID NO:2 and FIG. 1B):

M1 to A37; S2 to T38; G3 to Y39; E4 to L40; P5 to E41; G6 to L42; Q7 to A43; T8 to S44; S9 to A45; V10 to V46; A11 to K47; P12 to E48; P13 to Q49; P14 to Y50; E15 to P51; E16 to G52; V17 to I53; E18 to E54; P19 to I55; G20 to E56; S21 to S57; G22 to R58; V23 to L59; R24 to G60; I25 to G61; V26 to T62; V27 to G63; E28 to A64; Y29 to F65; C30 to E66; E31 to I67; P32 to E68; C33 to I69; G34 to N70; F35 to G71; A37 to L73; T38 to V74; Y39 to F75; L40 to S76; E41 to K77; L42 to L78; A43 to E79; S44 to N80; A45 to G81; V46 to G82; K47 to F83; E48 to P84; Q49 to Y85; Y50 to E86; P51 to K87; G52 to D88; I53 to L89; E54 to I90; I55 to E91; E56 to A92; S57 to I93; R58 to R94; L59 to R95; G60 to A96; G61 to S97; T62 to N98; G63 to G99; A64 to E100; F65 to T101; E66 to L102; I67 to E103; E68 to K104; I69 to I105; N70 to T106; G71 to N107; Q72 to S108; L73 to R109; V74 to P110; F75 to P111; S76 to C112; K77 to V113; L78 to I114; E79 to L115.

In another preferred embodiment, the isolated polypeptides of the present invention comprising or, alternatively, consisting of, one or more C35 peptide epitopes include the following 38mers (residues correspond to SEQ ID NO:2 and FIG. 1B):

M1 to T38; S2 to Y39; G3 to L40; E4 to E41; P5 to L42; G6 to A43; Q7 to S44; T8 to A45; S9 to V46; V10 to K47; A11 to E48; P12 to Q49; P13 to Y50; P14 to P51; E15 to G52; E16 to I53; V17 to E54; E18 to I55; P19 to E56; G20 to S57; S21 to R58; G22 to L59; V23 to G60; R24 to G61; I25 to T62; V26 to G63; V27 to A64; E28 to F65; Y29 to E66; C30 to I67; E31 to E68; P32 to I69; C33 to N70; G34 to G71; F35 to Q72; E36 to L73; A37 to V74; T38 to F75; Y39 to S76; L40 to K77; E41 to L78; L42 to E79; A43 to N80; S44 to G81; A45 to G82; V46 to F83; K47 to P84; E48 to Y85; Q49 to E86; Y50 to K87; P51 to D88; G52 to L89; I53 to I90; E54 to E91; I55 to A92; E56 to I93; S57 to R94; R58 to R95; L59 to A96; G60 to S97; G61 to N98; T62 to G99; G63 to E100; A64 to T101; F65 to L102; E66 to E103; I67 to K104; E68 to I105; I69 to T106; N70 to N107; G71 to S108; Q72 to R109; L73 to P110; V74 to P111; F75 to C112; S76 to V113; K77 to I114; L78 to L115.

In another preferred embodiment, the isolated polypeptides of the present invention comprising or, alternatively, consisting of, one or more C35 peptide epitopes include the following 39mers (residues correspond to SEQ ID NO:2 and FIG. 1B):

M1 to Y39; S2 to L40; G3 to E41; E4 to L42; P5 to A43; G6 to S44; Q7 to A45; T8 to V46; S9 to K47; V10 to E48; A11 to Q49; P12 to Y50; P13 to P51; P14 to G52; E15 to I53; E16 to E54; V17 to I55; E18 to E56; P19 to S57; G20 to R58; S21 to L59; G22 to G60; V23 to G61; R24 to T62; I25 to G63; V26 to A64; V27 to F65; E28 to E66; Y29 to I67; C30 to E68; E31 to I69; P32 to N70; C33 to G71; G34 to Q72; F35 to L73; E36 to V74; A37 to F75; T38 to S76; Y39 to K77; L40 to L78; E41 to E79; L42 to N80; A43 to G81; S44 to G82; A45 to F83; V46 to P84; K47 to Y85; E48 to E86; Q49 to K87; Y50 to D88; P51 to L89; G52 to I90; I53 to E91; E54 to A92; I55 to I93; E56 to R94; S57 to R95; R58 to A96; L59 to S97; G60 to N98; G61 to G99; T62 to E100; G63 to T101; A64 to L102; F65 to E103; E66 to K104; I67 to I105; E68 to T106; I69 to N107; N70 to S108; G71 to R109; Q72 to P110; L73 to P111; V74 to C112; F75 to V113; S76 to I114; K77 to L115.

In another preferred embodiment, the isolated polypeptides of the present invention comprising or, alternatively, consisting of, one or more C35 peptide epitopes include the following 40mers (residues correspond to SEQ ID NO:2 and FIG. 1B):

M1 to L40; S2 to E41; G3 to L42; E4 to A43; P5 to S44; G6 to A45; Q7 to V46; T8 to K47; S9 to E48; V10 to Q49; A11 to Y50; P12 to P51; P13 to G52; P14 to I53; E15 to E54; E16 to I55; V17 to E56; E18 to S57; P19 to R58; G20 to L59; S21 to G60; G22 to G61; V23 to T62; R24 to G63; I25 to A64; V26 to F65; V27 to E66; E28 to I67; Y29 to E68; C30 to I69; E31 to N70; P32 to G71; C33 to Q72; G34 to L73; F35 to V74; E36 to F75; A37 to S76; T38 to K77; Y39 to L78; L40 to E79; E41 to N80; L42 to G81; A43 to G82; S44 to F83; A45 to P84; V46 to Y85; K47 to E86; E48 to K87; Q49 to D88; Y50 to L89; P51 to I90; G52 to E91; I53 to A92; E54 to I93; I55 to R94; E56 to R95; S57 to A96; R58 to S97; L59 to N98; G60 to G99; G61 to E100; T62 to T101; G63 to L102; A64 to E103; F65 to K104; E66 to I105; I67 to T106; E68 to N107; I69 to S108; N70 to R109; G71 to P110; Q72 to P111; L73 to C112; V74 to V113; F75 to I114; S76 to L115.

In another preferred embodiment, the isolated polypeptides of the present invention comprising or, alternatively, consisting of, one or more C35 peptide epitopes include the following 41mers (residues correspond to SEQ ID NO:2 and FIG. 1B):

M1 to E41; S2 to L42; G3 to A43; E4 to S44; P5 to A45; G6 to V46; Q7 to K47; T8 to E48; S9 to Q49; V10 to Y50; A11 to P51; P12 to G52; P13 to I53; P14 to E54; E15 to I55; E16 to E56; V17 to S57; E18 to R58; P19 to L59; G20 to G60; S21 to G61; G22 to T62; V23 to G63; R24 to A64; I25 to F65; V26 to E66; V27 to I67; E28 to E68; Y29 to I69; C30 to N70; E31 to G71; P32 to Q72; C33 to L73; G34 to V74; F35 to F75; E36 to S76; A37 to K77; T38 to L78; Y39 to E79; L40 to N80; E41 to G81; L42 to G82; A43 to F83; S44 to P84; A45 to Y85; V46 to E86; K47 to K87; E48 to D88; Q49 to L89; Y50 to I90; P51 to E91; G52 to A92; I53 to I93; E54 to R94; I55 to R95; E56 to A92; S57 to S97; R58 to N98; L59 to G99; G60 to E100; G61 to T101; T62 to L102; G63 to E103; A64 to K104; F65 to I105; E66 to T106; I67 to N107; E68 to S108; I69 to R109; N70 to P110; G71 to P111; Q72 to C112; L73 to V113; V74 to I114; F75 to L115.

In another preferred embodiment, the isolated polypeptides of the present invention comprising or, alternatively, consisting of, one or more C35 peptide epitopes include the following 42mers (residues correspond to SEQ ID NO:2 and FIG. 1B):

M1 to L42; S2 to A43; G3 to S44; E4 to A45; P5 to V46; G6 to K47; Q7 to E48; T8 to Q49; S9 to Y50; V10 to P51; A11 to G52; P12 to I53; P13 to E54; P14 to I55; E15 to E56; E16 to S57; V17 to R58; E18 to L59; P19 to G60; G20 to G61; S21 to T62; G22 to G63; V23 to A64; R24 to F65; I25 to E66; V26 to I67; V27 to E68; E28 to I69; Y29 to N70; C30 to G71; E31 to Q72; P32 to L73; C33 to V74; G34 to F75; F35 to S76; E36 to K77; A37 to L78; T38 to E79; Y39 to N80; L40 to G81; E41 to G82; L42 to F83; A43 to P84; S44 to Y85; A45 to E86; V46 to K87; K47 to D88; E48 to L89; Q49 to I90; Y50 to E91; P51 to A92; G52 to I93; I53 to R94; E54 to R95; I55 to A96; E56 to S97; S57 to N98; R58 to G99; L59 to E100; G60 to T101; G61 to L102; T62 to E103; G63 to K104; A64 to I105; F65 to T106; E66 to N107; I67 to S108; E68 to R109; I69 to P110; N70 to P111; G71 to C112; Q72 to V113; L73 to I114; V74 to L115.

In another preferred embodiment, the isolated polypeptides of the present invention comprising or, alternatively, consisting of, one or more C35 peptide epitopes include the following 43mers (residues correspond to SEQ ID NO:2 and FIG. 1B):

M1 to A43; S2 to S44; G3 to A45; E4 to V46; P5 to K47; G6 to E48; Q7 to Q49; T8 to Y50; S9 to P51; V10 to G52; A11 to I53; P12 to E54; P13 to I55; P14 to E56; E15 to S57; E16 to R58; V17 to L59; E18 to G60; P19 to G61; G20 to T62; S21 to G63; G22 to A64; V23 to F65; R24 to E66; I25 to I67; V26 to E68; V27 to I69; E28 to N70; Y29 to G71; C30 to Q72; E31 to L73; P32 to V74; C33 to F75; G34 to S76; F35 to K77; E36 to L78; A37 to E79; T38 to N80; Y39 to G81; L40 to G82; E41 to F83; L42 to P84; A43 to Y85; S44 to E86; A45 to K87; V46 to D88; K47 to L89; E48 to I90; Q49 to E91; Y50 to A92; P51 to I93; G52 to R94; I53 to R95; E54 to A96; I55 to S97; E56 to N98; S57 to G99; R58 to E100; L59 to T101; G60 to L102; G61 to E103; T62 to K104; G63 to I105; A64 to T106; F65 to N107; E66 to S108; I67 to R109; E68 to P110; I69 to P111; N70 to C112; G71 to V113; Q72 to I114; L73 to L115.

In another preferred embodiment, the isolated polypeptides of the present invention comprising or, alternatively, consisting of, one or more C35 peptide epitopes include the following 44mers (residues correspond to SEQ ID NO:2 and FIG. 1B):

M1 to S44; S2 to A45; G3 to V46; E4 to K47; P5 to E48; G6 to Q49; Q7 to Y50; T8 to P51; S9 to G52; V10 to I53; A11 to E54; P12 to I55; P13 to E56; P14 to S57; E15 to R58; E16 to L59; V17 to G60; E18 to G61; P19 to T62; G20 to G63; S21 to A64; G22 to F65; V23 to E66; R24 to I67; I25 to E68; V26 to I69; V27 to N70; E28 to G71; Y29 to Q72; C30 to L73; E31 to V74; P32 to F75; C33 to S76; G34 to K77; F35 to L78; E36 to E79; A37 to N80; T38 to G81; Y39 to G82; L40 to F83; E41 to P84; L42 to Y85; A43 to E86; S44 to K87; A45 to D88; V46 to L89; K47 to I90; E48 to E91; Q49 to A92; Y50 to I93; P51 to R94; G52 to R95; I53 to A96; E54 to S97; I55 to N98; E56 to G99; S57 to E100; R58 to T101; L59 to L102; G60 to E103; G61 to K104; T62 to I105; G63 to T106; A64 to N107; F65 to S108; E66 to R109; I67 to P110; E68 to P111; I69 to C112; N70 to V113; G71 to I114; Q72 to L115.

In another preferred embodiment, the isolated polypeptides of the present invention comprising or, alternatively, consisting of, one or more C35 peptide epitopes include the following 45mers (residues correspond to SEQ ID NO:2 and FIG. 1B):

M1 to A45; S2 to V46; G3 to K47; E4 to E48; P5 to Q49; G6 to Y50; Q7 to P51; T8 to G52; S9 to I53; V10 to E54; A11 to I55; P12 to E56; P13 to S57; P14 to R58; E15 to L59; E16 to G60; V17 to G61; E18 to T62; P19 to G63; G20 to A64; S21 to F65; G22 to E66; V23 to I67; R24 to E68; I25 to I69; V26 to N70; V27 to G71; E28 to Q72; Y29 to L73; C30 to V74; E31 to F75; P32 to S76; C33 to K77; G34 to L78; F35 to E79; E36 to N80; A37 to G81; T38 to G82; Y39 to F83; L40 to P84; E41 to Y85; L42 to E86; A43 to K87; S44 to D88; A45 to L89; V46 to I90; K47 to E91; E48 to E92; Q49 to I93; Y50 to R94; P51 to R95; G52 to A96; I53 to S97; E54 to N98; I55 to G99; E56 to E100; S57 to T101; R58 to L102; L59 to E103; G60 to K104; G61 to K105; T62 to T106; G63 to N107; A64 to S108; F65 to R109; E66 to P110; I67 to P111; E68 to C112; I69 to V113; N70 to I114; G71 to L115.

In another preferred embodiment, the isolated polypeptides of the present invention comprising or, alternatively, consisting of, one or more C35 peptide epitopes include the following 46mers (residues correspond to SEQ ID NO:2 and FIG. 1B):

M1 to V46; S2 to K47; G3 to E48; E4 to Q49; P5 to Y50; G6 to P51; Q7 to G52; T8 to I53; S9 to E54; V10 to I55; A11 to E56; P12 to S57; P13 to R58; P14 to L59; E15 to G60; E16 to G61; V17 to T62; E18 to G63; P19 to A64; G20 to F65; S21 to E66; G22 to I67; V23 to E68; R24 to I69; I25 to N70; V26 to G71; V27 to Q72; E28 to L73; Y29 to V74; C30 to F75; E31 to S76; P32 to K77; C33 to L78; G34 to E79; F35 to N80; E36 to G81; A37 to G82; T38 to F83; Y39 to P84; L40 to Y85; E41 to E86; L42 to K87; A43 to D88; S44 to L89; A45 to I90; V46 to E91; K47 to A92; E48 to I93; Q49 to R94; Y50 to R95; P51 to A96; G52 to S97; I53 to N98; E54 to G99; I55 to E100; E56 to T101; S57 to L102; R58 to E103; L59 to K104; G60 to I105; G61 to T106; T62 to N107; G63 to S108; A64 to R109; F65 to P110; E66 to P111; I67 to C112; E68 to V113; I69 to I114; N70 to L115.

In another preferred embodiment, the isolated polypeptides of the present invention comprising or, alternatively, consisting of, one or more C35 peptide epitopes include the following 47mers (residues correspond to SEQ ID NO:2 and FIG. 1B):

M1 to K47; S2 to E48; G3 to Q49; E4 to Y50; P5 to P51; G6 to G52; Q7 to I53; T8 to E54; S9 to I55; V10 to E56; A11 to S57; P12 to R58; P13 to L59; P14 to G60; E15 to G61; E16 to T62; V17 to G63; E18 to A64; P19 to F65; G20 to E66; S21 to I67; G22 to E68; V23 to I69; R24 to N70; I25 to G71; V26 to Q72; V27 to L73; E28 to V74; Y29 to F75; C30 to S76; E31 to K77; P32 to L78; C33 to E79; G34 to N80; F35 to G81; E36 to G82; A37 to F83; T38 to P84; Y39 to Y85; L40 to E86; E41 to K87; L42 to D88; A43 to L89; S44 to I90; A45 to E91; V46 to A92; K47 to I93; E48 to R94; Q49 to R95; Y50 to A96; P51 to S97; G52 to N98; I53 to G99; E54 to E100; I55 to T101; E56 to L102; S57 to E103; R58 to K104; L59 to I105; G60 to T106; G61 to N107; T62 to S108; G63 to R109; A64 to P110; F65 to P111; E66 to C112; I67 to V113; E68 to I114; I69 to L115.

In another preferred embodiment, the isolated polypeptides of the present invention comprising or, alternatively, consisting of, one or more C35 peptide epitopes include the following 48mers (residues correspond to SEQ ID NO:2 and FIG. 1B):

M1 to E48; S2 to Q49; G3 to Y50; E4 to P51; P5 to G52; G6 to I53; Q7 to E54; T8 to I55; S9 to E56; V10 to S57; A11 to R58; P12 to L59; P13 to G60; P14 to G61; E15 to T62; E16 to G63; V17 to A64; E18 to F65; P19 to E66; G20 to I67; S21 to E68; G22 to I69; V23 to N70; R24 to G71; I25 to Q72; V26 to L73; V27 to V74; E28 to F75; Y29 to S76; C30 to K77; E31 to L78; P32 to E79; C33 to N80; G34 to G81; F35 to G82; E36 to F83; A37 to P84; T38 to Y85; Y39 to E86; L40 to K87; E41 to D88; L42 to L89; A43 to I90; S44 to E91; A45 to A92; V46 to I93; K47 to R94; E48 to R95; Q49 to A96; Y50 to S97; P51 to N98; G52 to G99; I53 to E100; E54 to T101; I55 to L102; E56 to E103; S57 to K104; R58 to I105; L59 to T106; G60 to

N107; G61 to S108; T62 to R109; G63 to P110; A64 to P111; F65 to C112; E66 to V113; I67 to I114; E68 to L115.

In another preferred embodiment, the isolated polypeptides of the present invention comprising or, alternatively, consisting of, one or more C35 peptide epitopes include the following 49mers (residues correspond to SEQ ID NO:2 and FIG. 1B):

M1 to Q49; S2 to Y50; G3 to P51; E4 to G52; P5 to I53; G6 to E54; Q7 to I55; T8 to E56; S9 to S57; V10 to R58; A11 to L59; P12 to G60; P13 to G61; P14 to T62; E15 to G63; E16 to A64; V17 to F65; E18 to E66; P19 to I67; G20 to E68; S21 to I69; G22 to N70; V23 to G71; R24 to Q72; I25 to L73; V26 to V74; V27 to F75; E28 to S76; Y29 to K77; C30 to L78; E31 to E79; P32 to N80; C33 to G81; G34 to G82; F35 to F83; E36 to P84; A37 to Y85; T38 to E86; Y39 to K87; L40 to D88; E41 to L89; L42 to I90; A43 to E91; S44 to A92; A45 to I93; V46 to R94; K47 to R95; E48 to A96; Q49 to S97; Y50 to N98; P51 to G99; G52 to E100; I53 to T101; E54 to L102; I55 to E103; E56 to K104; S57 to I105; R58 to T106; L59 to N107; G60 to S108; G61 to R109; T62 to P110; G63 to P111; A64 to C112; F65 to V113; E66 to I114; I67 to L115.

In another preferred embodiment, the isolated polypeptides of the present invention comprising or, alternatively, consisting of, one or more C35 peptide epitopes include the following 50mers (residues correspond to SEQ ID NO:2 and FIG. 1B):

M1 to Y50; S2 to P51; G3 to G52; E4 to I53; P5 to E54; G6 to I55; Q7 to E56; T8 to S57; S9 to R58; V10 to L59; A11 to G60; P12 to G61; P13 to T62; P14 to G63; E15 to A64; E16 to F65; V17 to E66; E18 to I67; P19 to E68; G20 to I69; S21 to N70; G22 to G71; V23 to Q72; R24 to L73; I25 to V74; V26 to F75; V27 to S76; E28 to K77; Y29 to L78; C30 to E79; E31 to N80; P32 to G81; C33 to G82; G34 to F83; F35 to P84; E36 to Y85; A37 to E86; T38 to K87; Y39 to D88; L40 to L89; E41 to I90; L42 to E91; A43 to A92; S44 to I93; A45 to R94; V46 to R95; K47 to A96; E48 to S97; Q49 to N98; Y50 to G99; P51 to E100; G52 to T101; I53 to L102; E54 to E103; I55 to K104; E56 to I105; S57 to T106; R58 to N107; L59 to S108; G60 to R109; G61 to P110; T62 to P111; G63 to C112; A64 to V113; F65 to I114; E66 to L115.

In another preferred embodiment, the isolated polypeptides of the present invention comprising or, alternatively, consisting of, one or more C35 peptide epitopes include the following 51mers (residues correspond to SEQ ID NO:2 and FIG. 1B):

M1 to P51; S2 to G52; G3 to I53; E4 to E54; P5 to I55; G6 to E56; Q7 to S57; T8 to R58; S9 to L59; V10 to G60; A11 to G61; P12 to T62; P13 to G63; P14 to A64; E15 to F65; E16 to E66; V17 to I67; E18 to E68; P19 to I69; G20 to N70; S21 to G71; G22 to Q72; V23 to L73; R24 to V74; I25 to F75; V26 to S76; V27 to K77; E28 to L78; Y29 to E79; C30 to N80; E31 to G81; P32 to G82; C33 to F83; G34 to P84; F35 to Y85; E36 to E86; A37 to K87; T38 to D88; Y39 to L89; L40 to I90; E41 to E91; L42 to A92; A43 to I93; S44 to R94; A45 to R95; V46 to A96; K47 to S97; E48 to N98; Q49 to G99; Y50 to E100; P51 to T101; G52 to L102; I53 to E103; E54 to K104; I55 to I105; E56 to T106; S57 to N107; R58 to S108; L59 to R109; G60 to P110; G61 to P111; T62 to C112; G63 to V113; A64 to I114; F65 to L115.

In another preferred embodiment, the isolated polypeptides of the present invention comprising or, alternatively, consisting of, one or more C35 peptide epitopes include the following 52mers (residues correspond to SEQ ID NO:2 and FIG. 1B):

M1 to G52; S2 to I53; G3 to E54; E4 to I55; P5 to E56; G6 to S57; Q7 to R58; T8 to L59; S9 to G60; V10 to G61; A11 to T62; P12 to G63; P13 to A64; P14 to F65; E15 to E66; E16 to I67; V17 to E68; E18 to I69; P19 to N70; G20 to G71; S21 to Q72; G22 to L73; V23 to V74; R24 to F75; I25 to S76; V26 to K77; V27 to L78; E28 to E79; Y29 to N80; C30 to G81; E31 to G82; P32 to F83; C33 to P84; G34 to Y85; F35 to E86; E36 to K87; A37 to D88; T38 to L89; Y39 to I90; L40 to E91; E41 to A92; L42 to I93; A43 to R94; S44 to R95; A45 to A96; V46 to S97; K47 to N98; E48 to G99; Q49 to E100; Y50 to T101; P51 to L102; G52 to E103; I53 to K104; E54 to I105; I55 to T106; E56 to N107; S57 to S108; R58 to R109; L59 to P110; G60 to P111; G61 to C112; T62 to V113; G63 to I114; A64 to L115.

In another preferred embodiment, the isolated polypeptides of the present invention comprising or, alternatively, consisting of, one or more C35 peptide epitopes include the following 53mers (residues correspond to SEQ ID NO:2 and FIG. 1B):

M1 to I53; S2 to E54; G3 to I55; E4 to E56; P5 to S57; G6 to R58; Q7 to L59; T8 to G60; S9 to G61; V10 to T62; A11 to G63; P12 to A64; P13 to F65; P14 to E66; E15 to I67; E16 to E68; V17 to I69; E18 to N70; P19 to G71; G20 to Q72; S21 to L73; G22 to V74; V23 to F75; R24 to S76; I25 to K77; V26 to L78; V27 to E79; E28 to N80; Y29 to G81; C30 to G82; E31 to F83; P32 to P84; C33 to Y85; G34 to E86; F35 to K87; E36 to D88; A37 to L89; T38 to I90; Y39 to E91; L40 to A92; E41 to I93; L42 to R94; A43 to R95; S44 to A96; A45 to S97; V46 to N98; K47 to G99; E48 to E100; Q49 to T101; Y50 to L102; P51 to E103; G52 to K104; I53 to I105; E54 to T106; I55 to N107; E56 to S108; S57 to R109; R58 to P110; L59 to P111; G60 to C112; G61 to V113; T62 to I114; G63 to L115.

In another preferred embodiment, the isolated polypeptides of the present invention comprising or, alternatively, consisting of, one or more C35 peptide epitopes include the following 54mers (residues correspond to SEQ ID NO:2 and FIG. 1B):

M1 to E54; S2 to I55; G3 to E56; E4 to S57; P5 to R58; G6 to L59; Q7 to G60; T8 to G61; S9 to T62; V10 to G63; A11 to A64; P12 to F65; P13 to E66; P14 to I67; E15 to E68; E16 to I69; V17 to N70; E18 to G71; P19 to Q72; G20 to L73; S21 to V74; G22 to F75; V23 to S76; R24 to K77; I25 to L78; V26 to E79; V27 to N80; E28 to G81; Y29 to G82; C30 to F83; E31 to P84; P32 to Y85; C33 to E86; G34 to K87; F35 to D88; E36 to L89; A37 to I90; T38 to E91; Y39 to A92; L40 to I93; E41 to R94; L42 to R95; A43 to A96; S44 to S97; A45 to N98; V46 to G99; K47 to E100; E48 to T101; Q49 to L102; Y50 to E103; P51 to K104; G52 to I105; I53 to T106; E54 to N107; I55 to S108; E56 to R109; S57 to P110; R58 to P111; L59 to C112; G60 to V113; G61 to I114; T62 to L115.

In another preferred embodiment, the isolated polypeptides of the present invention comprising or, alternatively, consisting of, one or more C35 peptide epitopes include the following 55mers (residues correspond to SEQ ID NO:2 and FIG. 1B):

M1 to I55; S2 to E56; G3 to S57; E4 to R58; P5 to L59; G6 to G60; Q7 to G61; T8 to T62; S9 to G63; V10 to A64; A11 to F65; P12 to E66; P13 to I67; P14 to E68; E15 to I69; E16 to N70; V17 to G71; E18 to Q72; P19 to L73; G20 to V74; S21 to F75; G22 to S76; V23 to K77; R24 to L78; I25 to E79; V26 to N80; V27 to G81; E28 to G82; Y29 to F83; C30 to P84; E31 to Y85; P32 to E86; C33 to K87; G34 to D88; F35 to L89; E36 to I90; A37 to E91; T38 to A92; Y39 to I93; L40 to R94; E41 to R95; L42 to A96; A43 to S97; S44 to N98; A45 to G99; V46 to E100; K47 to T101; E48 to L102; Q49 to E103; Y50 to K104; P51 to I105; G52 to T106; I53 to N107; E54 to S108; I55 to R109; E56 to P110; S57 to P111; R58 to C112; L59 to V113; G60 to I114; G61 to L115.

In another preferred embodiment, the isolated polypeptides of the present invention comprising or, alternatively, consisting of, one or more C35 peptide epitopes include the following 56mers (residues correspond to SEQ ID NO:2 and FIG. 1B):

M1 to E56; S2 to S57; G3 to R58; E4 to L59; P5 to G60; G6 to G61; Q7 to T62; T8 to G63; S9 to A64; V10 to F65; A11 to E66; P12 to I67; P13 to E68; P14 to I69; E15 to N70; E16 to G71; V17 to Q72; E18 to L73; P19 to V74; G20 to F75; S21 to S76; G22 to K77; V23 to L78; R24 to E79; I25 to N80; V26 to G81; V27 to G82; E28 to F83; Y29 to P84; C30 to Y85; E31 to E86; P32 to K87; C33 to D88; G34 to L89; F35 to I90; E36 to E91; A37 to A92; T38 to I93; Y39 to R94; L40 to R95; E41 to A96; L42 to S97; A43 to N98; S44 to G99; A45 to E100; V46 to T100; K47 to L102; E48 to E103; Q49 to K104; Y50 to I105; P51 to T106; G52 to N107; I53 to S108; E54 to R109; I55 to P110; E56 to P111; S57 to C112; R58 to V113; L59 to I114; G60 to L115.

In another preferred embodiment, the isolated polypeptides of the present invention comprising or, alternatively, consisting of, one or more C35 peptide epitopes include the following 57mers (residues correspond to SEQ ID NO:2 and FIG. 1B):

M1 to S57; S2 to R58; G3 to L59; E4 to G60; P5 to G61; G6 to T62; Q7 to G63; T8 to A64; S9 to F65; V10 to E66; A11 to I67; P12 to E68; P13 to I69; P14 to N70; E15 to G71; E16 to Q72; V17 to L73; E18 to V74; P19 to F75; G20 to S76; S21 to K77; G22 to L78; V23 to E79; R24 to N80; I25 to G81; V26 to G82; V27 to F83; E28 to P84; Y29 to Y85; C30 to E86; E31 to K87; P32 to D88; C33 to L89; G34 to I90; F35 to E91; E36 to A92; A37 to I93; T38 to R94; Y39 to R95; L40 to A96; E41 to S97; L42 to N98; A43 to G99; S44 to E100; A45 to T100; V46 to L102; K47 to E103; E48 to K104; Q49 to I105; Y50 to T106; P51 to N107; G52 to S108; I53 to R109; E54 to P110; I55 to P111; E56 to C112; S57 to V113; R58 to I114; L59 to L115.

In another preferred embodiment, the isolated polypeptides of the present invention comprising or, alternatively, consisting of, one or more C35 peptide epitopes include the following 58mers (residues correspond to SEQ ID NO:2 and FIG. 1B):

M1 to R58; S2 to L59; G3 to G60; E4 to G61; P5 to T62; G6 to G63; Q7 to A64; T8 to F65; S9 to E66; V10 to I67; A11 to E68; P12 to I69; P13 to N70; P14 to G71; E15 to Q72; E16 to L73; V17 to V74; E18 to F75; P19 to S76; G20 to K77; S21 to L78; G22 to E79; V23 to N80; R24 to G81; I25 to G82; V26 to F83; V27 to P84; E28 to Y85; Y29 to E86; C30 to K87; E31 to E88; P32 to L89; C33 to I90; G34 to E91; F35 to A92; E36 to I93; A37 to R94; T38 to R95; Y39 to A96; L40 to S97; E1 to N98; L42 to G99; A43 to E100; S44 to T101; A45 to L102; V46 to E103; K47 to K104; E48 to I105; Q49 to T106; Y50 to N107; P51 to S108; G52 to R109; I53 to P110; E54 to P111; I55 to C112; E56 to V113; S57 to I114; R58 to L115.

In another preferred embodiment, the isolated polypeptides of the present invention comprising or, alternatively, consisting of, one or more C35 peptide epitopes include the following 59mers (residues correspond to SEQ ID NO:2 and FIG. 1B):

M1 to L59; S2 to G60; G3 to G61; E4 to T62; P5 to G63; G6 to A64; Q7 to F65; T8 to E66; S9 to I67; V10 to E68; A11 to I69; P12 to N70; P13 to G71; P14 to Q72; E15 to L73; E16 to V74; V17 to F75; E18 to S76; P19 to K77; G20 to L78; S21 to E79; G22 to N80; V23 to G81; R24 to G82; I25 to F83; V26 to P84; V27 to Y85; E28 to E86; Y29 to K87; C30 to D88; E31 to L89; P32 to I90; C33 to E91; G34 to A92; F35 to I93; E36 to R94; A37 to R95; T38 to A96; Y39 to S97; L40 to N98; E41 to G99; L42 to E100; A43 to T101; S44 to L102; A45 to E103; V46 to K104; K47 to I105; E48 to T106; Q49 to N107; Y50 to S108; P51 to R109; G52 to P110; I53 to P111; E54 to C112; I55 to V113; E56 to I114; S57 to L115.

In another preferred embodiment, the isolated polypeptides of the present invention comprising or, alternatively, consisting of, one or more C35 peptide epitopes include the following 60mers (residues correspond to SEQ ID NO:2 and FIG. 1B):

M1 to G60; S2 to G61; G3 to T62; E4 to G63; P5 to A64; G6 to F65; Q7 to E66; T8 to I67; S9 to E68; V10 to I69; A11 to N70; P12 to G71; P13 to Q72; P14 to L73; E15 to V74; E16 to F75; V17 to S76; E18 to K77; P19 to L78; G20 to E79; S21 to N80; G22 to G81; V23 to G82; R24 to F83; I25 to P84; V26 to Y85; V27 to E86; E28 to K87; Y29 to D88; C30 to L89; E31 to I90; P32 to E91; C33 to A92; G34 to I93; F35 to R94; E36 to R95; A37 to A96; T38 to S97; Y39 to N98; L40 to G99; E41 to E100; L42 to T101; A43 to L102; S44 to E103; A45 to K104; V46 to I105; K47 to T106; E48 to N107; Q49 to S108; Y50 to R109; P51 to P110; G52 to P111; I53 to C112; E54 to V113; I55 to I114; E56 to L115.

In another preferred embodiment, the isolated polypeptides of the present invention comprising or, alternatively, consisting of, one or more C35 peptide epitopes include the following 61mers (residues correspond to SEQ ID NO:2 and FIG. 1B):

M1 to G61; S2 to T62; G3 to G63; E4 to A64; P5 to F65; G6 to E66; Q7 to I67; T8 to E68; S9 to I69; V10 to N70; A11 to G71; P12 to Q72; P13 to L73; P14 to V74; E15 to F75; E16 to S76; V17 to K77; E18 to L78; P19 to E79; G20 to N80; S21 to G81; G22 to G82; V23 to F83; R24 to P84; I25 to Y85; V26 to E86; V27 to K87; E28 to D88; Y29 to L89; C30 to I90; E31 to E91; P32 to A92; C33 to I93; G34 to R94; F35 to R95; E36 to A96; A37 to S97; T38 to N98; Y39 to G99; L40 to E100; E41 to T101; L42 to L102; A43 to E103; S44 to K104; A45 to I105; V46 to T106; K47 to N107; E48 to S108; Q49 to R109; Y50 to P110; P51 to P111; G52 to C112; I53 to V113; E54 to I114; I55 to L115.

In another preferred embodiment, the isolated polypeptides of the present invention comprising or, alternatively, consisting of, one or more C35 peptide epitopes include the following 62mers (residues correspond to SEQ ID NO:2 and FIG. 1B):

M1 to T62; S2 to G63; G3 to A64; E4 to F65; P5 to E66; G6 to I67; Q7 to E68; T8 to I69; S9 to N70; V10 to G71; A11 to Q72; P12 to L73; P13 to V74; P14 to F75; E15 to S76; E16 to K77; V17 to L78; E18 to E79; P19 to N80; G20 to G81; S21 to G82; G22 to F83; V23 to P84; R24 to Y85; I25 to E86; V26 to K87; V27 to D88; E28 to L89; Y29 to I90; C30 to E91; E31 to A92; P32 to I93; C33 to R94; G34 to R95; F35 to A96; E36 to S97; A37 to N98; T38 to G99; Y39 to E100; L40 to T101; E41 to L102; L42 to E103; A43 to K104; S44 to I105; A45 to T106; V46 to N107; K47 to S108; E48 to R109; Q49 to P110; Y50 to P111; P51 to C112; G52 to V113; I53 to I114; E54 to L115.

In another preferred embodiment, the isolated polypeptides of the present invention comprising or, alternatively, consisting of, one or more C35 peptide epitopes include the following 63mers (residues correspond to SEQ ID NO:2 and FIG. 1B):

M1 to G63; S2 to A64; G3 to F65; E4 to E66; P5 to I67; G6 to E68; Q7 to I69; T8 to N70; S9 to G71; V10 to Q72; A11 to L73; P12 to V74; P13 to F75; P14 to S76; E15 to K77; E16 to L78; V17 to E79; E18 to N80; P19 to G81; G20 to G82; S21 to F83; G22 to P84; V23 to Y85; R24 to E86; I25 to K87; V26 to D88; V27 to L89; E28 to I90; Y29 to E91; C30 to A92; E31 to I93; P32 to R94; C33 to R95; G34 to A96; F35 to S97; E36 to N98; A37 to G99; T38 to E100; Y39 to T101; L40 to L102; E41 to E103; L42 to K104; A43 to I105; S44 to T106; A45 to

N107; V46 to S108; K47 to R109; E48 to P110; Q49 to P111; Y50 to C112; P51 to V113; G52 to I114; I53 to L115.

In another preferred embodiment, the isolated polypeptides of the present invention comprising or, alternatively, consisting of, one or more C35 peptide epitopes include the following 64mers (residues correspond to SEQ ID NO:2 and FIG. 1B):

M1 to A64; S2 to F65; G3 to E66; E4 to I67; P5 to E68; G6 to I69; Q7 to N70; T8 to G71; S9 to Q72; V10 to L73; A11 to V74; P12 to F75; P13 to S76; P14 to K77; E15 to L78; E16 to E79; V17 to N80; E18 to G81; P19 to G82; G20 to F83; S21 to P84; G22 to Y85; V23 to E86; R24 to K87; I25 to D88; V26 to L89; V27 to I90; E28 to E91; Y29 to A92; C30 to I93; E31 to R94; P32 to R95; C33 to A96; G34 to S97; F35 to N98; E36 to G99; A37 to E100; T38 to T101; Y39 to L102; L40 to E103; E41 to K104; L42 to I105; A43 to T106; S44 to N107; A45 to S108; V46 to R109; K47 to P110; E48 to P111; Q49 to C112; Y50 to V113; P51 to I114; G52 to L115.

In another preferred embodiment, the isolated polypeptides of the present invention comprising or, alternatively, consisting of, one or more C35 peptide epitopes include the following 65mers (residues correspond to SEQ ID NO:2 and FIG. 1B):

M1 to F65; S2 to E66; G3 to I67; E4 to E68; P5 to I69; G6 to N70; Q7 to G71; T8 to Q72; S9 to L73; V10 to V74; A11 to F75; P12 to S76; P13 to K77; P14 to L78; E15 to E79; E16 to N80; V17 to G81; E18 to G82; P19 to F83; G20 to P84; S21 to Y85; G22 to E86; V23 to K87; R24 to D88; I25 to L89; V26 to I90; V27 to E91; E28 to A92; Y29 to I93; C30 to R94; E31 to R95; P32 to A96; C33 to S97; G34 to N98; F35 to G99; E36 to E100; A37 to T101; T38 to L102; Y39 to E103; L40 to K104; E41 to I105; L42 to T106; A43 to N107; S44 to S108; A45 to R109; V46 to P110; K47 to P111; E48 to C112; Q49 to V113; Y50 to I114; P51 to L115.

In another preferred embodiment, the isolated polypeptides of the present invention comprising or, alternatively, consisting of, one or more C35 peptide epitopes include the following 66mers (residues correspond to SEQ ID NO:2 and FIG. 1B):

M1 to E66; S2 to I67; G3 to E68; E4 to I69; P5 to N70; G6 to G71; Q7 to Q72; T8 to L73; S9 to V74; V10 to F75; A11 to S76; P12 to K77; P13 to L78; P14 to E79; E15 to N80; E16 to G81; V17 to G82; E18 to F83; P19 to P84; G20 to Y85; S21 to E86; G22 to K87; V23 to D88; R24 to L89; I25 to I90; V26 to E91; V27 to A92; E28 to I93; Y29 to R94; C30 to R95; E31 to A96; P32 to S97; C33 to N98; G34 to G99; F35 to E100; E36 to T101; A37 to L102; T38 to E103; Y39 to K104; L40 to I105; E41 to T106; L42 to N107; A43 to S108; S44 to R109; A45 to P110; V46 to P111; K47 to C112; E48 to V113; Q49 to I114; Y50 to L115.

In another preferred embodiment, the isolated polypeptides of the present invention comprising or, alternatively, consisting of, one or more C35 peptide epitopes include the following 67mers (residues correspond to SEQ ID NO:2 and FIG. 1B):

M1 to I67; S2 to E68; G3 to I69; E4 to N70; P5 to G71; G6 to Q72; Q7 to L73; T8 to V74; S9 to F75; V10 to S76; A11 to K77; P12 to L78; P13 to E79; P14 to N80; E15 to G81; E16 to G82; V17 to F83; E18 to P84; P19 to Y85; G20 to E86; S21 to K87; G22 to D88; V23 to L89; R24 to I90; I25 to E91; V26 to A92; V27 to I93; E28 to R94; Y29 to R95; C30 to A96; E31 to S97; P32 to N98; C33 to G99; G34 to E100; F35 to T101; E36 to L102; A37 to E103; T38 to K104; Y39 to I105; L40 to T106; E41 to N107; L42 to S108; A43 to R109; S44 to P110; A45 to P111; V46 to C112; K47 to V113; E48 to I114; Q49 to L115.

In another preferred embodiment, the isolated polypeptides of the present invention comprising or, alternatively, consisting of, one or more C35 peptide epitopes include the following 68mers (residues correspond to SEQ ID NO:2 and FIG. 1B):

M1 to E68; S2 to I69; G3 to N70; E4 to G71; P5 to Q72; G6 to L73; Q7 to V74; T8 to F75; S9 to S76; V10 to K77; A11 to L78; P12 to E79; P13 to N80; P14 to G81; E15 to G82; E16 to F83; V17 to P84; E18 to Y85; P19 to E86; G20 to K87; S21 to D88; G22 to L89; V23 to I90; R24 to E91; I25 to A92; V26 to I93; V27 to R94; E28 to R95; Y29 to A96; C30 to S97; E31 to N98; P32 to G99; C33 to E100; G34 to T101; F35 to L102; E36 to E103; A37 to K104; T38 to I105; Y39 to T106; L40 to N107; E41 to S108; L42 to R109; A43 to P110; S44 to P111; A45 to C112; V46 to V113; K47 to I114; E48 to L115.

In another preferred embodiment, the isolated polypeptides of the present invention comprising or, alternatively, consisting of, one or more C35 peptide epitopes include the following 69mers (residues correspond to SEQ ID NO:2 and FIG. 1B):

M1 to I69; S2 to N70; G3 to G71; E4 to Q72; P5 to L73; G6 to V74; Q7 to F75; T8 to S76; S9 to K77; V10 to L78; A11 to E79; P12 to N80; P13 to G81; P14 to G82; E15 to F83; E16 to P84; V17 to Y85; E18 to E86; P19 to K87; G20 to D88; S21 to L89; G22 to I90; V23 to E91; R24 to A92; I25 to I93; V26 to R94; V27 to R95; E28 to A96; Y29 to S97; C30 to N98; E31 to G99; P32 to E100; C33 to T101; G34 to L102; F35 to E103; E36 to K104; A37 to I105; T38 to T106; Y39 to N107; L40 to S108; E41 to R109; L42 to P110; A43 to P111; S44 to C112; A45 to V113; V46 to I114; K47 to L115.

In another preferred embodiment, the isolated polypeptides of the present invention comprising or, alternatively, consisting of, one or more C35 peptide epitopes include the following 70mers (residues correspond to SEQ ID NO:2 and FIG. 1B):

M1 to N70; S2 to G71; G3 to Q72; E4 to L73; P5 to V74; G6 to F75; Q7 to S76; T8 to K77; S9 to L78; V10 to E79; A11 to N80; P12 to G81; P13 to G82; P14 to F83; E15 to P84; E16 to Y85; V17 to E86; E18 to K87; P19 to D88; G20 to L89; S21 to I90; G22 to E91; V23 to A92; R24 to I93; I25 to R94; V26 to R95; V27 to A96; E28 to S97; Y29 to N98; C30 to G99; E31 to E100; P32 to T101; C33 to L102; G34 to E103; F35 to K104; E36 to I105; A37 to T106; T38 to N107; Y39 to S108; L40 to R109; E41 to P110; L42 to P111; A43 to C112; S44 to V113; A45 to I114; V46 to L115.

In another preferred embodiment, the isolated polypeptides of the present invention comprising or, alternatively, consisting of, one or more C35 peptide epitopes include the following 71mers (residues correspond to SEQ ID NO:2 and FIG. 1B):

M1 to G71; S2 to Q72; G3 to L73; E4 to V74; P5 to F75; G6 to S76; Q7 to K77; T8 to L78; S9 to E79; V10 to N80; A11 to G81; P12 to G82; P13 to F83; P14 to P84; E15 to Y85; E16 to E86; V17 to K87; E18 to D88; P19 to L89; G20 to I90; S21 to E91; G22 to A92; V23 to I93; R24 to R94; I25 to R95; V26 to A96; V27 to S97; E28 to N98; Y29 to G99; C30 to E100; E31 to T101; P32 to L102; C33 to E103; G34 to K104; F35 to I105; E36 to T106; A37 to N107; T38 to S108; Y39 to R109; L40 to P110; E41 to P111; L42 to C112; A43 to V113; S44 to I114; A45 to L115.

In another preferred embodiment, the isolated polypeptides of the present invention comprising or, alternatively, consisting of, one or more C35 peptide epitopes include the following 72mers (residues correspond to SEQ ID NO:2 and FIG. 1B):

M1 to Q72; S2 to L73; G3 to V74; E4 to F75; P5 to S76; G6 to K77; Q7 to L78; T8 to E79; S9 to N80; V10 to G81; A11 to

G82; P12 to F83; P13 to P84; P14 to Y85; E15 to E86; E16 to K87; V17 to D88; E18 to L89; P19 to I90; G20 to E91; S21 to A92; G22 to I93; V23 to R94; R24 to R95; I25 to A96; V26 to S97; V27 to N98; E28 to G99; Y29 to E100; C30 to T101; E31 to L102; P32 to E103; C33 to K104; G34 to I105; F35 to T106; E36 to N107; A37 to S108; T38 to R109; Y39 to P110; L40 to P111; E41 to C112; L42 to V113; A43 to I114; S44 to L115.

In another preferred embodiment, the isolated polypeptides of the present invention comprising or, alternatively, consisting of, one or more C35 peptide epitopes include the following 73mers (residues correspond to SEQ ID NO:2 and FIG. 1B):

M1 to L73; S2 to V74; G3 to F75; E4 to S76; P5 to K77; G6 to L78; Q7 to E79; T8 to N80; S9 to G81; V10 to G82; A11 to F83; P12 to P84; P13 to Y85; P14 to E86; E15 to K87; E16 to D88; V17 to L89; E18 to I90; P19 to E91; G20 to A92; S21 to I93; G22 to R94; V23 to R95; R24 to A96; I25 to S97; V26 to N98; V27 to G99; E28 to E100; Y29 to T101; C30 to L102; E31 to E103; P32 to K104; C33 to I105; G34 to T106; F35 to N107; E36 to S108; A37 to R109; T38 to P110; Y39 to P111; L40 to C112; E41 to V113; L42 to I114; A43 to L115.

In another preferred embodiment, the isolated polypeptides of the present invention comprising or, alternatively, consisting of, one or more C35 peptide epitopes include the following 74mers (residues correspond to SEQ ID NO:2 and FIG. 1B):

M1 to V74; S2 to F75; G3 to S76; E4 to K77; P5 to L78; G6 to E79; Q7 to N80; T8 to G81; S9 to G82; V10 to F83; A11 to P84; P12 to Y85; P13 to E86; P14 to K87; E15 to D88; E16 to L89; V17 to I90; E18 to E91; P19 to A92; G20 to I93; S21 to R94; G22 to R95; V23 to A96; R24 to S97; I25 to N98; V26 to G99; V27 to E100; E28 to T100; Y29 to L102; C30 to E103; E31 to K104; P32 to I105; C33 to T106; G34 to N107; F35 to S108; E36 to R109; A37 to P110; T38 to P111; Y39 to C112; L40 to V113; E41 to I114; L42 to L115.

In another preferred embodiment, the isolated polypeptides of the present invention comprising or, alternatively, consisting of, one or more C35 peptide epitopes include the following 75mers (residues correspond to SEQ ID NO:2 and FIG. 1B):

M1 to F75; S2 to S76; G3 to K77; E4 to L78; P5 to E79; G6 to N80; Q7 to G81; T8 to G82; S9 to F83; V10 to P84; A11 to Y85; P12 to E86; P13 to K87; P14 to D88; E15 to L89; E16 to I90; V17 to E91; E18 to A92; P19 to I93; G20 to R94; S21 to R95; G22 to A96; V23 to S97; R24 to N98; I25 to G99; V26 to E100; V27 to T101; E28 to L102; Y29 to E103; C30 to K104; E31 to I105; P32 to T106; C33 to N107; G34 to S108; F35 to R109; E36 to P110; A37 to P111; T38 to C112; Y39 to V113; L40 to I114; E41 to L115.

In another preferred embodiment, the isolated polypeptides of the present invention comprising or, alternatively, consisting of, one or more C35 peptide epitopes include the following 76mers (residues correspond to SEQ ID NO:2 and FIG. 1B):

M1 to S76; S2 to K77; G3 to L78; E4 to E79; P5 to N80; G6 to G81; Q7 to G82; T8 to F83; S9 to P84; V10 to Y85; A11 to E86; P12 to K87; P13 to D88; P14 to L89; E15 to I90; E16 to E91; V17 to A92; E18 to I93; P19 to R94; G20 to R95; S21 to A96; G22 to S97; V23 to N98; R24 to G99; I25 to E100; V26 to T101; V27 to L102; E28 to E103; Y29 to K104; C30 to I105; E31 to T106; P32 to N107; C33 to S108; G34 to R109; F35 to P110; E36 to P111; A37 to C112; T38 to V113; Y39 to I114; L40 to L115.

In another preferred embodiment, the isolated polypeptides of the present invention comprising or, alternatively, consisting of, one or more C35 peptide epitopes include the following 77mers (residues correspond to SEQ ID NO:2 and FIG. 1B):

M1 to K77; S2 to L78; G3 to E79; E4 to N80; P5 to G81; G6 to G82; Q7 to F83; T8 to P84; S9 to Y85; V10 to E86; A11 to K87; P12 to D88; P13 to L89; P14 to I90; E15 to E91; E16 to A92; V17 to I93; E18 to R94; P19 to R95; G20 to A96; S21 to S97; G22 to N98; V23 to G99; R24 to E100; I25 to T101; V26 to L102; V27 to E103; E28 to K104; Y29; I105; C30 to T106; E31 to N107; P32 to S108; C33 to R109; G34 to P110; F35 to P111; E36 to C112; A37 to V113; T38 to I114; Y39 to L115.

In another preferred embodiment, the isolated polypeptides of the present invention comprising or, alternatively, consisting of, one or more C35 peptide epitopes include the following 78mers (residues correspond to SEQ ID NO:2 and FIG. 1B):

M1 to L78; S2 to E79; G3 to N80; E4 to G81; P5 to G82; G6 to F83; Q7 to P84; T8 to Y85; S9 to E86; V10 to K87; A11 to D88; P12 to L89; P13 to I90; P14 to E91; E15 to A92; E16 to I93; V17 to R94; E18 to R95; P19 to A96; G20 to S97; S21 to N98; G22 to G99; V23 to E100; R24 to T101; I25 to L102; V26 to E103; V27 to K104; E28 to I105; Y29 to T106; C30 to N107; E31 to S108; P32 to R109; C33 to P110; G34 to P111; F35 to C112; E36 to V113; A37 to I114; T38 to L115.

In another preferred embodiment, the isolated polypeptides of the present invention comprising or, alternatively, consisting of, one or more C35 peptide epitopes include the following 79mers (residues correspond to SEQ ID NO:2 and FIG. 1B):

M1 to E79; S2 to N80; G3 to G81; E4 to G82; P5 to F83; G6 to P84; Q7 to Y85; T8 to E86; S9 to K87; V10 to D88; A11 to L89; P12 to I90; P13 to E91; P14 to A92; E15 to I93; E16 to R94; V17 to R95; E18 to A96; P19 to S97; G20 to N98; S21 to G99; G22 to E100; V23 to T101; R24 to L102; I25 to E103; V26 to K104; V27 to I105; E28 to T106; Y29 to N107; C30 to S108; E31 to R109; P32 to P110; C33 to P111; G34 to C112; F35 to V113; E36 to I114; A37 to L115.

In another preferred embodiment, the isolated polypeptides of the present invention comprising or, alternatively, consisting of, one or more C35 peptide epitopes include the following 80mers (residues correspond to SEQ ID NO:2 and FIG. 1B):

M1 to N80; S2 to G81; G3 to G82; E4 to F83; P5 to P84; G6 to Y85; Q7 to E86; T8 to K87; S9 to D88; V10 to L89; A11 to I90; P12 to E91; P13 to A92; P14 to I93; E15 to R94; E16 to R95; V17 to A96; E18 to S97; P19 to N98; G20 to G99; S21 to E100; G22 to T101; V23 to L102; R24 to E103; I25 to K104; V26 to I105; V27 to T106; E28 to N107; Y29 to S108; C30 to R109; E31 to P110; P32 to P111; C33 to C112; G34 to V113; F35 to I114; E36 to L115.

In another preferred embodiment, the isolated polypeptides of the present invention comprising or, alternatively, consisting of, one or more C35 peptide epitopes include the following 81mers (residues correspond to SEQ ID NO:2 and FIG. 1B):

M1 to G81; S2 to G82; G3 to F83; E4 to P84; P5 to Y85; G6 to E86; Q7 to K87; T8 to D88; S9 to L89; V10 to I90; A11 to E91; P12 to A92; P13 to I93; P14 to R94; E15 to R95; E16 to A96; V17 to S97; E18 to N98; P19 to G99; G20 to E100; S21 to T101; G22 to L102; V23 to E103; R24 to K104; I25 to I105; V26 to T106; V27 to N107; E28 to S108; Y29 to R109; C30 to P110; E31 to P111; P32 to C112; C33 to V113; G34 to I114; F35 to L115.

In another preferred embodiment, the isolated polypeptides of the present invention comprising or, alternatively, consisting of, one or more C35 peptide epitopes include the following 82mers (residues correspond to SEQ ID NO:2 and FIG. 1B):

M1 to G82; S2 to F83; G3 to P84; E4 to Y85; P5 to E86; G6 to K87; Q7 to D88; T8 to L89; S9 to I90; V10 to E91; A11 to A92; P12 to I93; P13 to R94; P14 to R95; E15 to A96; E16 to S97; V17 to N98; E18 to G99; P19 to E100; G20 to T101; S21 to L102; G22 to E103; V23 to K104; R24 to I105; I25 to T106; V26 to N107; V27 to S108; E28 to R109; Y29 to P110; C30 to P111; E31 to C112; P32 to V113; C33 to I114; G34 to L115.

In another preferred embodiment, the isolated polypeptides of the present invention comprising or, alternatively, consisting of, one or more C35 peptide epitopes include the following 83mers (residues correspond to SEQ ID NO:2 and FIG. 1B):

M1 to F83; S2 to P84; G3 to Y85; E4 to E86; P5 to K87; G6 to D88; Q7 to L89; T8 to I90; S9 to E91; V10 to A92; A11 to I93; P12 to R94; P13 to R95; P14 to A96; E15 to S97; E16 to N98; V17 to G99; E18 to E100; P19 to T101; G20 to L102; S21 to E103; G22 to K104; V23 to I105; R24 to T106; I25 to N107; V26 to S108; V27 to R109; E28 to P110; Y29 to P111; C30 to C112; E31 to V113; P32 to I114; C33 to L115.

In another preferred embodiment, the isolated polypeptides of the present invention comprising or, alternatively, consisting of, one or more C35 peptide epitopes include the following 84mers (residues correspond to SEQ ID NO:2 and FIG. 1B):

M1 to P84; S2 to Y85; G3 to E86; E4 to K87; P5 to D88; G6 to L89; Q7 to I90; T8 to E91; S9 to A92; V10 to I93; A11 to R94; P12 to R95; P13 to A96; P14 to S97; E15 to N98; E16 to G99; V17 to E100; E18 to T101; P19 to L102; G20 to E103; S21 to K104; G22 to I105; V23 to T106; R24 to N107; I25 to S108; V26 to R109; V27 to P110; E28 to P111; Y29 to C112; C30 to V113; E31 to I114; P32 to L115.

In another preferred embodiment, the isolated polypeptides of the present invention comprising or, alternatively, consisting of, one or more C35 peptide epitopes include the following 85mers (residues correspond to SEQ ID NO:2 and FIG. 1B):

M1 to Y85; S2 to E86; G3 to K87; E4 to D88; P5 to L89; G6 to I90; Q7 to E91; T8 to A92; S9 to I93; V10 to R94; A11 to R95; P12 to A96; P13 to S97; P14 to N98; E15 to G99; E16 to E100; V17 to T101; E18 to L102; P19 to E103; G20 to K104; S21 to I105; G22 to T106; V23 to N107; R24 to S108; I25 to R109; V26 to P110; V27 to P111; E28 to C112; Y29 to V113; C30 to I114; E31 to L115.

In another preferred embodiment, the isolated polypeptides of the present invention comprising or, alternatively, consisting of, one or more C35 peptide epitopes include the following 86mers (residues correspond to SEQ ID NO:2 and FIG. 1B):

M1 to E86; S2 to K87; G3 to D88; E4 to L89; P5 to I90; G6 to E91; Q7 to A92; T8 to I93; S9 to R94; V10 to R95; A11 to A96; P12 to S97; P13 to N98; P14 to G99; E15 to E100; E16 to T101; V17 to L102; E18 to E103; P19 to K104; G20 to I105; S21 to T106; G22 to N107; V23 to S108; R24 to R109; I25 to P110; V26 to P111; V27 to C112; E28 to V113; Y29 to I114; C30 to L115.

In another preferred embodiment, the isolated polypeptides of the present invention comprising or, alternatively, consisting of, one or more C35 peptide epitopes include the following 87mers (residues correspond to SEQ ID NO:2 and FIG. 1B):

M1 to K87; S2 to D88; G3 to L89; E4 to I90; P5 to E91; G6 to A92; Q7 to I93; T8 to R94; S9 to R95; V10 to A96; A11 to S97; P12 to N98; P13 to G99; P14 to E100; E15 to T101; E16 to L102; V17 to E103; E18 to K104; P19 to I105; G20 to T106; S21 to N107; G22 to S108; V23 to R109; R24 to P110; I25 to P111; V26 to C112; V27 to V113; E28 to I114; Y29 to L115.

In another preferred embodiment, the isolated polypeptides of the present invention comprising or, alternatively, consisting of, one or more C35 peptide epitopes include the following 88mers (residues correspond to SEQ ID NO:2 and FIG. 1B):

M1 to D88; S2 to L89; G3 to I90; E4 to E91; P5 to A92; G6 to I93; Q7 to R94; T8 to R95; S9 to A96; V10 to S97; A11 to N98; P12 to G99; P13 to E100; P14 to T101; E15 to L102; E16 to E103; V17 to K104; E18 to I105; P19 to T106; G20 to N107; S21 to S108; G22 to R109; V23 to P110; R24 to P111; I25 to C112; V26 to V113; V27 to I114; E28 to L115.

In another preferred embodiment, the isolated polypeptides of the present invention comprising or, alternatively, consisting of, one or more C35 peptide epitopes include the following 89mers (residues correspond to SEQ ID NO:2 and FIG. 1B):

M1 to L89; S2 to I90; G3 to E91; E4 to A92; P5 to I93; G6 to R94; Q7 to R95; T8 to A96; S9 to S97; V10 to N98; A11 to G99; P12 to E100; P13 to T101; P14 to L102; E15 to E103; E16 to K104; V17 to I105; E18 to T106; P19 to N107; G20 to S108; S21 to R109; G22 to P110; V23 to P111; R24 to C112; I25 to V113; V26 to I114; V27 to L115.

In another preferred embodiment, the isolated polypeptides of the present invention comprising or, alternatively, consisting of, one or more C35 peptide epitopes include the following 90mers (residues correspond to SEQ ID NO:2 and FIG. 1B):

M1 to I90; S2 to E91; G3 to A92; E4 to I93; P5 to R94; G6 to R95; Q7 to A96; T8 to S97; S9 to N98; V10 to G99; A11 to E100; P12 to T101; P13 to L102; P14 to E103; E15 to K104; E16 to I105; V17 to T106; E18 to N107; P19 to S108; G20 to R109; S21 to P110; G22 to P111; V23 to C112; R24 to V113; I25 to I114; V26 to L115.

In another preferred embodiment, the isolated polypeptides of the present invention comprising or, alternatively, consisting of, one or more C35 peptide epitopes include the following 91mers (residues correspond to SEQ ID NO:2 and FIG. 1B):

M1 to E91; S2 to A92; G3 to I93; E4 to R94; P5 to R95; G6 to A96; Q7 to S97; T8 to N98; S9 to G99; V10 to E100; A11 to T101; P12 to L102; P13 to E103; P14 to K104; E15 to I105; E16 to T106; V17 to N107; E18 to S108; P19 to R109; G20 to P110; S21 to P111; G22 to C112; V23 to V113; R24 to I114; I25 to L115.

In another preferred embodiment, the isolated polypeptides of the present invention comprising or, alternatively, consisting of, one or more C35 peptide epitopes include the following 92mers (residues correspond to SEQ ID NO:2 and FIG. 1B):

M1 to A92; S2 to I93; G3 to R94; E4 to R95; P5 to A96; G6 to S97; Q7 to N98; T8 to G99; S9 to E100; V10 to T101; A11 to L102; P12 to E103; P13 to K104; P14 to I105; E15 to T106; E16 to N107; V17 to S108; E18 to R109; P19 to P110; G20 to P111; S21 to C112; G22 to V113; V23 to I114; R24 to L115.

In another preferred embodiment, the isolated polypeptides of the present invention comprising or, alternatively, consisting of, one or more C35 peptide epitopes include the following 93mers (residues correspond to SEQ ID NO:2 and FIG. 1B):

M1 to I93; S2 to R94; G3 to R95; E4 to A96; P5 to S97; G6 to N98; Q7 to G99; T8 to E100; S9 to T10; V10 to L102; A11 to E103; P12 to K104; P13 to I105; P14 to T106; E15 to N107;

E16 to S108; V17 to R109; E18 to P110; P19 to P111; G20 to C112; S21 to V113; G22 to I114; V23 to L115.

In another preferred embodiment, the isolated polypeptides of the present invention comprising or, alternatively, consisting of, one or more C35 peptide epitopes include the following 94mers (residues correspond to SEQ ID NO:2 and FIG. 1B):

M1 to R94; S2 to R95; G3 to A96; E4 to S97; P5 to N98; G6 to G99; Q7 to E100; T8 to T101; S9 to L102; V10 to E103; A11 to K104; P12 to I105; P13 to T106; P14 to N107; E15 to S108; E16 to R109; V17 to P110; E18 to P111; P19 to C112; G20 to V113; S21 to I114; G22 to L115.

In another preferred embodiment, the isolated polypeptides of the present invention comprising or, alternatively, consisting of, one or more C35 peptide epitopes include the following 95mers (residues correspond to SEQ ID NO:2 and FIG. 1B): M1 to R95; S2 to A96; G3 to S97; E4 to N98; P5 to G99; G6 to E100; Q7 to T101; T8 to L102; S9 to E103; V10 to K104; A11 to I105; P12 to T106; P13 to N107; P14 to S108; E15 to R109; E16 to P110; V17 to P111; E18 to C112; P19 to V113; G20 to I114; S21 to L115.

In another preferred embodiment, the isolated polypeptides of the present invention comprising or, alternatively, consisting of, one or more C35 peptide epitopes include the following 96mers (residues correspond to SEQ ID NO:2 and FIG. 1B):

M1 to A96; S2 to S97; G3 to N98; E4 to G99; P5 to E100; G6 to T101; Q7 to L102; T8 to E103; S9 to K104; V10 to I105; A11 to T106; P12 to N107; P13 to S108; P14 to R109; E15 to P110; E16 to P111; V17 to C112; E18 to V113; P19 to I114; G20 to L115.

In another preferred embodiment, the isolated polypeptides of the present invention comprising or, alternatively, consisting of, one or more C35 peptide epitopes include the following 97mers (residues correspond to SEQ ID NO:2 and FIG. 1B):

M1 to S97; S2 to N98; G3 to G99; E4 to E100; P5 to T101; G6 to L102; Q7 to E103; T8 to K104; S9 to I105; V10 to T106; A11 to N107; P12 to S108; P13 to R109; P14 to P110; E15 to P111; E16 to C112; V17 to V113; E18 to I114; P19 to L115.

In another preferred embodiment, the isolated polypeptides of the present invention comprising or, alternatively, consisting of, one or more C35 peptide epitopes include the following 98mers (residues correspond to SEQ ID NO:2 and FIG. 1B):

M1 to N98; S2 to G99; G3 to E100; E4 to T100; P5 to L102; G6 to E103; Q7 to K104; T8 to I105; S9 to T106; V10 to N107; A11 to S108; P12 to R109; P13 to P110; P14 to P111; E15 to C112; E16 to V113; V17 to I114; E18 to L115.

In another preferred embodiment, the isolated polypeptides of the present invention comprising or, alternatively, consisting of, one or more C35 peptide epitopes include the following 99mers (residues correspond to SEQ ID NO:2 and FIG. 1B):

M1 to G99; S2 to E100; G3 to T101; E4 to L102; P5 to E103; G6 to K104; Q7 to I105; T8 to T106; S9 to N107; V10 to S108; A11 to R109; P12 to P110; P13 to P111; P14 to C112; E15 to V113; E16 to I114; V17 to L115.

In another preferred embodiment, the isolated polypeptides of the present invention comprising or, alternatively, consisting of, one or more C35 peptide epitopes include the following 100mers (residues correspond to SEQ ID NO:2 and FIG. 1B):

M1 to E100; S2 to T101; G3 to L102; E4 to E103; P5 to K104; G6 to I105; Q7 to T106; T8 to N107; S9 to S108; V10 to R109; A11 to P110; P12 to P111; P13 to C112; P14 to V113; E15 to I114; E16 to L115.

In another preferred embodiment, the isolated polypeptides of the present invention comprising or, alternatively, consisting of, one or more C35 peptide epitopes include the following 101mers (residues correspond to SEQ ID NO:2 and FIG. 1B):

M1 to T101; S2 to L102; G3 to E103; E4 to K104; P5 to I105; G6 to T106; Q7 to N107; T8 to S108; S9 to R109; V10 to P110; A11 to P111; P12 to C112; P13 to V113; P14 to I114; E15 to L115.

In another preferred embodiment, the isolated polypeptides of the present invention comprising or, alternatively, consisting of, one or more C35 peptide epitopes include the following 102mers (residues correspond to SEQ ID NO:2 and FIG. 1B):

M1 to L102; S2 to E103; G3 to K104; E4 to I105; P5 to T106; G6 to N107; Q7 to S108; T8 to R109; S9 to P110; V10 to P111; A11 to C112; P12 to V113; P13 to I114; P14 to L115.

In another preferred embodiment, the isolated polypeptides of the present invention comprising or, alternatively, consisting of, one or more C35 peptide epitopes include the following 103mers (residues correspond to SEQ ID NO:2 and FIG. 1B):

M1 to E103; S2 to K104; G3 to I105; E4 to T106; P5 to N107; G6 to S108; Q7 to R109; T8 to P110; S9 to P111; V10 to C112; A11 to V113; P12 to I114; P13 to L115.

In another preferred embodiment, the isolated polypeptides of the present invention comprising or, alternatively, consisting of, one or more C35 peptide epitopes include the following 104mers (residues correspond to SEQ ID NO:2 and FIG. 1B):

M1 to K104; S2 to I105; G3 to T106; E4 to N107; P5 to S108; G6 to R109; Q7 to P110; T8 to P111; S9 to C112; V10 to V113; A11 to I114; P12 to L115.

In another preferred embodiment, the isolated polypeptides of the present invention comprising or, alternatively, consisting of, one or more C35 peptide epitopes include the following 105mers (residues correspond to SEQ ID NO:2 and FIG. 1B):

M1 to I105; S2 to T106; G3 to N107; E4 to S108; P5 to R109; G6 to P110; Q7 to P111; T8 to C112; S9 to V113; V10 to I114; A11 to L115.

In another preferred embodiment, the isolated polypeptides of the present invention comprising or, alternatively, consisting of, one or more C35 peptide epitopes include the following 106mers (residues correspond to SEQ ID NO:2 and FIG. 1B):

M1 to T106; S2 to N107; G3 to S108; E4 to R109; P5 to P110; G6 to P111; Q7 to C112; T8 to V113; S9 to I114; V10 to L115.

In another preferred embodiment, the isolated polypeptides of the present invention comprising or, alternatively, consisting of, one or more C35 peptide epitopes include the following 107mers (residues correspond to SEQ ID NO:2 and FIG. 1B):

M1 to N107; S2 to S108; G3 to R109; E4 to P110; P5 to P111; G6 to C112; Q7 to V113; T8 to I114; S9 to L115.

In another preferred embodiment, the isolated polypeptides of the present invention comprising or, alternatively, consisting of, one or more C35 peptide epitopes include the following 108mers (residues correspond to SEQ ID NO:2 and FIG. 1B):

M1 to S108; S2 to R109; G3 to P110; E4 to P111; P5 to C112; G6 to V113; Q7 to I114; T8 to L115.

In another preferred embodiment, the isolated polypeptides of the present invention comprising or, alternatively, consisting of, one or more C35 peptide epitopes include the following 109mers (residues correspond to SEQ ID NO:2 and FIG. 1B):

M1 to R109; S2 to P110; G3 to P111; E4 to C112; P5 to V113; G6 to I114; Q7 to L115.

In another preferred embodiment, the isolated polypeptides of the present invention comprising or, alternatively, consisting of, one or more C35 peptide epitopes include the following 110mers (residues correspond to SEQ ID NO:2 and FIG. 1B):

M1 to P110; S2 to P111; G3 to C112; E4 to V113; P5 to I114; G6 to L115.

In another preferred embodiment, the isolated polypeptides of the present invention comprising or, alternatively, consisting of, one or more C35 peptide epitopes include the following 111mers (residues correspond to SEQ ID NO:2 and FIG. 1B):

M1 to P111; S2 to C112; G3 to V113; E4 to I114; P5 to L115.

In another preferred embodiment, the isolated polypeptides of the present invention comprising or, alternatively, consisting of, one or more C35 peptide epitopes include the following 112mers (residues correspond to SEQ ID NO:2 and FIG. 1B):

M1 to C112; S2 to V113; G3 to I114; E4 to L115.

In another preferred embodiment, the isolated polypeptides of the present invention comprising or, alternatively, consisting of, one or more C35 peptide epitopes include the following 113mers (residues correspond to SEQ ID NO:2 and FIG. 1B):

M1 to V113; S2 to I114; G3 to L115.

In another preferred embodiment, the isolated polypeptides of the present invention comprising or, alternatively, consisting of, one or more C35 peptide epitopes include the following 114mers (residues correspond to SEQ ID NO:2 and FIG. 1B):

M1 to I114; S2 to L115.

Stimulation of CTL and HTL Responses

Much more about the mechanism by which T cells recognize antigens has been elucidated during the past ten years. In accordance with this understanding of the immune system, the present inventors have developed efficacious peptide epitope compositions that induce a therapeutic or prophylactic immune response to certain tumor associated antigens, when administered via various art-accepted modalities. Moreover, by use of the peptide epitopes of the invention, or by use of combinations of peptide epitopes in accordance with the principles disclosed herein, responses can be achieved in significant percentages of a non-genetically biased worldwide population. For an understanding of the value and efficacy of the claimed compositions, a brief review of immunology-related technology is provided.

A complex of an HLA molecule and a peptidic antigen acts as the ligand recognized by HLA-restricted T cells (Buus, S. et al., *Cell* 47:1071, 1986; Babbitt, B. P. et al., *Nature* 317: 359, 1985; Townsend, A. and Bodmer, H., *Annu. Rev. Immunol.* 7:601, 1989; Germain, R. N., *Annu. Rev. Immunol.* 11:403, 1993). Through the study of single amino acid substituted antigen analogs and the sequencing of endogenously bound, naturally processed peptides, critical residues that correspond to motifs-required for specific binding to HLA antigen molecules have been identified.

Furthermore, x-ray crystallographic analyses of HLA-peptide complexes have revealed pockets within the peptide binding cleft of HLA molecules which accommodate, often on an allele-specific basis, residues borne by peptide ligands; these residues in turn determine the HLA binding capacity of the peptides in which they are present. (See, e.g., Madden, D. R. *Annu. Rev. Immunol.* 13:587, 1995; Smith, et al., *Immunity* 4:203, 1996; Fremont et al., *Immunity* 8:305, 1998; Stern et al., *Structure* 2:245, 1994; Jones, E. Y. *Curr. Opin. Immunol.* 9:75, 1997; Brown, J. H. et al., *Nature* 364:33, 1993; Guo, H. C. et al., *Proc. Natl. Acad. Sci. USA* 90:8053, 1993; Guo, H. C. et al., *Nature* 360:364, 1992; Silver, M. L. et al., *Nature* 360:367, 1992; Matsumura, M. et al., *Science* 257:927, 1992; Madden et al., *Cell* 70:1035, 1992; Fremont, D. H. et al., *Science* 257:919, 1992; Saper, M. A., Bjorkman, P. J. and Wiley, D. C., *J. Mol. Biol.* 219:277, 1991.) Accordingly, the definition of class I and class II allele-specific HLA binding motifs, or class I or class II supermotifs allows identification of regions within a protein that have the predicted ability to bind particular HLA antigen(s).

Moreover, the correlation of binding affinity with immunogenicity, which is disclosed herein, is an important factor to be considered when evaluating candidate peptides. Thus, by a combination of motif searches of antigenic sequences, and by HLA-peptide binding assays, epitope-based vaccines have been identified. As appreciated by one in the art, after determining their binding affinity, additional work can be performed to select, amongst these vaccine peptides, e.g., epitopes can be selected having optional characteristics in terms of population coverage, antigenicity, and immunogenicity, etc.

Various strategies can be utilized to evaluate immunogenicity, including:

1) Evaluation of primary T cell cultures from normal individuals (see, e.g., Wentworth, P. A. et al., *Mol. Immunol.* 32:603, 1995; Celis, E. et al., *Proc. Natl. Acad. Sci. USA* 91:2105, 1994; Tsai, V. et al., *J. Immunol.* 158:1796, 1997; Kawashima, I. et al., *Human Immunol.* 59:1, 1998). This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a 51Cr-release assay involving peptide sensitized target cells, and/or target cells that generate antigen endogenously.

2) Immunization of HLA transgenic mice (see, e.g., Wentworth, P. A. et al., *J. Immunol.* 26:97, 1996; Wentworth, P. A. et al., *Int. Immunol.* 8:651, 1996; Alexander, J. et al., *J. Immunol.* 159:4753, 1997); in this method, peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a 51Cr-release assay involving peptide sensitized target cells and target cells expressing endogenously generated antigen.

3) Demonstration of recall T cell responses from individuals exposed to the disease, such as immune individuals who were effectively treated and recovered from disease, and/or from actively ill patients (see, e.g., Rehermann, B. et al., *J. Exp. Med.* 181:1047, 1995; Doolan, D. L. et al., *Immunity* 7:97, 1997; Bertoni, R. et al., *J. Clin. Invest.* 100:503, 1997; Threlkeld, S. C. et al., *J. Immunol.* 159:1648, 1997; Diepolder, H. M. et al., *J. Virol.* 71:6011, 1997). In applying this strategy, recall responses are detected by culturing PBL from subjects in vitro for 1-2 weeks in the presence of a test peptide plus antigen presenting cells (APC) to allow activation of "memory" T cells, as compared to "naive" T cells. At the end of the culture period, T cell activity is detected using assays for T cell activity including $^{51}Cr$ release involving peptide-sensitized targets, T cell proliferation, or lymphokine release.

The following describes the peptide epitopes and corresponding nucleic acids of the invention in more detail.

Binding Affinity of Peptide Epitopes for HLA Molecules

As indicated herein, the large degree of HLA polymorphism is an important factor to be taken into account with the epitope-based approach to vaccine development. To address this factor, epitope selection encompassing identification of peptides capable of binding at high or intermediate affinity to multiple HLA molecules is preferably utilized, most preferably these epitopes bind at high or intermediate affinity to two or more allele-specific HLA molecules.

CTL-inducing peptide epitopes of interest for vaccine compositions preferably include those that have an $IC_{50}$ or binding affinity value for a class I HLA molecule(s) of 500 nM or better (i.e., the value is ≦500 nM). HTL-inducing peptide epitopes preferably include those that have an $IC_{50}$ or binding affinity value for class II HLA molecules of 1000 nM or better, (i.e., the value is ≦1,000 nM). For example, peptide binding is assessed by testing the capacity of a candidate peptide to bind to a purified HLA molecule in vitro. Peptides exhibiting high or intermediate affinity are then considered for further analysis. Selected peptides are generally tested on other members of the supertype family. In preferred embodiments, peptides that exhibit cross-reactive binding are then used in cellular screening analyses or vaccines.

The relationship between binding affinity for HLA class I molecules and immunogenicity of discrete peptide epitopes on bound antigens has been determined. As disclosed in greater detail herein, higher HLA binding affinity is correlated with greater immunogenicity.

Greater immunogenicity can be manifested in several different ways. Immunogenicity corresponds to whether an immune response is elicited at all, and to the vigor of any particular response, as well as to the extent of a population in which a response is elicited. For example, a peptide epitope might elicit an immune response in a diverse array of the population, yet in no instance produce a vigorous response. In accordance with these principles, close to 90% of high binding peptide have been found to elicit a response and thus be "immunogenic," as contrasted with about 50% of the peptides that bind with intermediate affinity. (See, e.g., Schaeffer et al. PNAS 1988) Moreover, not only did peptides with higher binding affinity have an enhanced probability of generating an immune response, the generated response tended to be more vigorous than the response seen with weaker binding peptides. As a result, less peptide is required to elicit a similar biological effect if a high affinity binding peptide is used rather than a lower affinity one. Thus, in preferred embodiments of the invention, high affinity binding epitopes are used.

The correlation between binding affinity and immunogenicity was analyzed by two different experimental approaches (see, e.g., Sette, et al., *J. Immunol.* 153:5586-5592, 1994)). In the first approach, the immunogenicity of potential epitopes ranging in HLA binding affinity over a 10,000-fold range was analyzed in HLA-A*0201 transgenic mice. In the second approach, the antigenicity of approximately 100 different hepatitis B virus (HBV)-derived potential epitopes, all carrying A*0201 binding motifs, was assessed by using PBL from acute hepatitis patients. Pursuant to these approaches, it was determined that an affinity threshold value of approximately 500 nM (preferably 50 nM or less) determines the capacity of a peptide epitope to elicit a CTL response. These data are true for class I binding affinity measurements for naturally processed peptide epitopes and for synthesized T cell epitopes. These data also indicate the important role of determinant selection in the shaping of T cell responses (see, e.g., Schaeffer et al. *Proc. Natl. Acad. Sci. USA* 86:4649-4653, 1989).

An affinity threshold associated with immunogenicity in the context of HLA class II (i.e., HLA DR) molecules has also been delineated (see, e.g., Southwood et al. *J. Immunology* 160:3363-3373, 1998. In order to define a biologically significant threshold of HLA class II binding affinity, a database of the binding affinities of 32 DR-restricted epitopes for their restricting element (i.e., the HLA molecule that binds the epitope) was compiled. In approximately half of the cases (15 of 32 epitopes), DR restriction was associated with high binding affinities, i.e. binding affinity values of 100 nM or less. In the other half of the cases (16 of 32), DR restriction was associated with intermediate affinity (binding affinity values in the 1001000 nM range). In only one of 32 cases was DR restriction associated with an $IC_{50}$ of 1000 nM or greater. Thus, 1000 nM is defined as an affinity threshold associated with immunogenicity in the context of DR molecules.

Vaccines of the present invention may also comprise epitopes that bind to MHC class II DR molecules. A greater degree of heterogeneity in both size and binding frame position of the motif, relative to the N and C termini of the peptide, exists for class II peptide ligands. This increased heterogeneity of HLA class II peptide ligands is due to the structure of the binding groove of the HLA class II molecule which, unlike its class I counterpart, is less physically constricted at both ends.

There are numerous additional supermotifs and motifs in addition to the A2 supermotif and the A2.1-allele specific motif. By inclusion of one or more epitopes from other motifs or supermotifs, enhanced population coverage for major global ethnicities can be obtained.

Peptide Analogs

In general, CTL and HTL responses are not directed against all possible epitopes. Rather, they are restricted to a few "immunodominant" determinants (Zinkernagel, et al., *Adv. Immunol.* 27:5159, 1979; Bennink, et al., *J. Exp. Med.* 168:19351939, 1988; Rawle, et al., *J. Immunol.* 146:3977-3984, 1991). It has been recognized that immunodominance (Benacerraf, et al., *Science* 175:273-279, 1972) could be explained by either the ability of a given epitope to selectively bind a particular HLA protein (determinant selection theory) (Vitiello, et al., *J. Immunol.* 131:1635, 1983); Rosenthal, et al., *Nature* 267:156-158, 1977), or to be selectively recognized by the existing TCR (T cell receptor) specificities (repertoire theory) (Klein, J., IMMUNOLOGY, THE SCIENCE OF SELFNON-SELF DISCRIMINATION, John Wiley & Sons, New York, pp. 270-310, 1982). It has been demonstrated that additional factors, mostly linked to processing events, can also play a key role in dictating, beyond strict immunogenicity, which of the many potential determinants will be presented as immunodominant (Sercarz, et al., *Annu. Rev. Immunol.* 11:729-766, 1993).

The concept of dominance and subdominance is relevant to immunotherapy of both infectious diseases and malignancies. For example, in the course of chronic viral disease, recruitment of subdominant epitopes can be important for successful clearance of the infection, especially if dominant CTL or HTL specificities have been inactivated by functional tolerance, suppression, mutation of viruses and other mechanisms (Franco, et al., *Curr. Opin. Immunol.* 7:524-531, 1995). In the case of cancer and tumor antigens, CTLs recognizing at least some of the highest binding affinity peptides might be functionally inactivated. Lower binding affinity peptides are preferentially recognized at these times, and may therefore be preferred in therapeutic or prophylactic anti-cancer vaccines.

In particular, it has been noted that a significant number of epitopes derived from known non-viral tumor associated antigens (TAA) bind HLA class I with intermediate affinity ($IC_{50}$ in the 50-500 nM range) rather than at high affinity ($IC_{50}$ of less than 50 nM).

For example, it has been found that 8 of 15 known TAA peptides recognized by tumor infiltrating lymphocytes (TIL) or CTL bound in the 50-500 nM range. (These data are in contrast with estimates that 90% of known viral antigens were bound by HLA class I molecules with $IC_{50}$ of 50 nM or less, while only approximately 10% bound in the 50-500 nM range (Sette, et al., *J. Immunol.,* 153:558-5592, 1994). In the cancer setting this phenomenon is probably due to elimination or functional inhibition of the CTL recognizing several of the highest binding peptides, presumably because of T cell tolerization events.

Without intending to be bound by theory, it is believed that because T cells to dominant epitopes may have been clonally deleted, and selecting subdominant epitopes may allow existing T cells to be recruited, which will then lead to a therapeutic or prophylactic response. However, the binding of HLA molecules to subdominant epitopes is often less vigorous than to dominant ones.

Accordingly, there is a need to be able to modulate the binding affinity of particular immunogenic epitopes for one or more HLA molecules, to thereby modulate the immune response elicited by the peptide, for example to prepare analog peptides which elicit a more vigorous response. This ability to modulate both binding affinity and the resulting immune response in accordance with these principles greatly enhances the usefulness of peptide epitope-based vaccines and therapeutic agents.

Although peptides with suitable cross-reactivity among all alleles of a superfamily are identified by the screening procedures described above, cross-reactivity is not always as complete as possible, and in certain cases procedures to increase cross-reactivity of peptides can be useful; moreover, such procedures can also be used to modify other properties of the peptides such as binding affinity or peptide stability. Having established the general rules that govern cross-reactivity of peptides for HLA alleles within a given motif or supermotif, modification (i.e., analoging) of the structure of peptides of particular interest in order to achieve broader (or otherwise modified) HLA binding capacity can be performed. More specifically, peptides that exhibit the broadest cross-reactivity patterns, can be produced in accordance with the teachings herein.

In brief, the analoging strategy utilizes the motifs or supermotifs that correlate with binding to certain HLA molecules. Analog peptides can be created by substituting amino acid residues at primary anchor, secondary anchor, or at primary and secondary anchor positions. Generally, analogs are made for peptides that already bear a motif or supermotif. For a number of the motifs or supermotifs, residues are defined which are deleterious to binding to allele-specific HLA molecules or members of HLA supertypes that bind the respective motif or supermotif. Accordingly, removal of such residues that are detrimental to binding can be performed. For example, in the case of the A3 supertype, when all peptides that have such deleterious residues are removed from the population of peptides used in the analysis, the incidence of cross-reactivity increased from 22% to 37% (see, e.g., Sidney, J. et al., *Hu. Immunol.* 45:79, 1996). Examples of C35 peptide epitope analogs of the present invention are found in Table 4. In a particularly preferred embodiment, the isolated polypeptides of the present invention comprise or, alternatively, consist of the following C35 peptide epitope analogs: for the peptide epitope G22 to C30 of SEQ ID NO:2 and FIG. 1B (i.e., GVRIVVEYC), the analog with either alanine or glycine substituted for cysteine at the ninth amino acid residue (i.e., GVRIVVEYA (SEQ ID NO: 161) or GVRIVVEYG (SEQ ID NO: 162)); for the peptide epitope I25 to C33 of SEQ ID NO:2 and FIG. 1B (i.e., IVVEYCEPC), the analog with either alanine or glycine substituted for the cysteine at the sixth amino acid residue and/or the ninth amino acid residue (i.e., IVVEYAEPC (SEQ ID NO: 163), IVVEYCEPA (SEQ ID NO: 164), IVVEYGEPC (SEQ ID NO: 165), IVVEYCEPG (SEQ ID NO: 166), IVVEYAEP A (SEQ ID NO: 167), IVVEYAEPG (SEQ ID NO: 168), IVVEYGEPA (SEQ ID NO: 169), IVVEYGEPG (SEQ ID NO: 170)); for the peptide epitope K77 to Y85 of SEQ ID NO: 2 and FIG. 1B (i.e., KLENGGFPY), the analog with valine substituted for tyrosine at the ninth amino acid residue (i.e., KLENGGFPV (SEQ ID NO: 171)); for peptide epitope K104 to C112 of SEQ ID NO:2 and FIG. 1B (i.e., KITNSRPPC), the analogs with alanine, glycine or leucine substituted for cysteine at the ninth amino acid residue (i.e., KITNSRPPL (SEQ ID NO: 172), KITNSRPPA (SEQ ID NO: 173), KITNSRPPG (SEQ ID NO: 174)); for peptide epitope K104 to V113 of SEQ ID NO:2 and FIG. 1B (i.e., KITNSRPPCV), the analogs with alanine, glycine, serine or leucine substituted for cysteine at the ninth amino acid residue (i.e., KITNSRPPLV (SEQ ID NO: 175), KITNSRPPAV (SEQ ID NO: 176), KITNSRP-PGV (SEQ ID NO: 177), KITNSRPPSV (SEQ ID NO: 178)), for the peptide epitope I105 to V113 of SEQ ID NO:2 and FIG. 1B (i.e., ITNSRPPCV), the analogs wherein either leucine or methionine is substituted for threonine at the second amino acid residue and/or alanine, serine or glycine is substituted for cysteine at the eighth amino acid residue (i.e., ILNSRPPCV (SEQ ID NO: 179), IMNSRPPCV (SEQ ID NO: 180), ITNSRPPAV (SEQ ID NO: 181), ITNSRPPGV (SEQ ID NO: 182), ILNSRPPAV (SEQ ID NO: 183), ILN-SRPPGV (SEQ ID NO: 184), IMNSRPPAV (SEQ ID NO: 185), IMNSRPPGV (SEQ ID NO: 186), ILNSRPPSV (SEQ ID NO: 187), IMNSRPPSV (SEQ ID NO: 188), ITNSRPPSV (SEQ ID NO: 189)), for the peptide epitope N107 to L115 of SEQ ID NO:2 and FIG. 1B (i.e., NSRPPCVIL), the analog with either alanine or glycine substituted for cysteine at the sixth amino acid residue (i.e., NSRPPAVIL (SEQ ID NO: 190), NSRPPGVIL (SEQ ID NO: 191)). The invention is further directed to polypeptides comprising or, alternatively, consisting of one or more C35 epitope analogs. In a preferred embodiment, the invention is directed to polypeptides comprising one or more C35 epitope analogs and, in addition, one or more C35 peptide epitopes. In a particularly preferred embodiment, the invention is directed to a fusion protein comprising at least one C35 peptide epitope analog selected from the group consisting of: for the peptide epitope G22 to C30 of SEQ ID NO:2 and FIG. 1B (i.e., GVRIVVEYC), the analog with either alanine or glycine substituted for cysteine at the ninth amino acid residue (i.e., GVRIVVEYA (SEQ ID NO: 161) or GVRIVVEYG (SEQ ID NO: 162)); for the peptide epitope I25 to C33 of SEQ ID NO:2 and FIG. 1B (i.e., IVVEYCEPC), the analog with either alanine or glycine substituted for the cysteine at the sixth amino acid residue and/or the ninth amino acid residue (i.e., IVVEYAEPC (SEQ ID NO: 163), IVVEYCEPA (SEQ ID NO: 164), IVVEYGEPC (SEQ ID NO: 165), IVVEYCEPG (SEQ ID NO: 166), IVVEYAEPA (SEQ ID NO: 167), IVVEYAEP G (SEQ ID NO: 168), IVVEYGEPA (SEQ ID NO: 169), IVVEYGEPG (SEQ ID NO: 170)); for the peptide epitope K77 to Y85 of SEQ ID NO: 2 and FIG. 1B (i.e., KLENGGFPY), the analog with valine substituted for tyrosine at the ninth amino acid residue (i.e., KLENGGFPV (SEQ ID NO: 171)); for peptide epitope K104 to C112 of SEQ ID NO:2 and FIG. 1B (i.e., KITNSRPPC), the analogs with alanine, glycine or leucine substituted for cysteine at the ninth amino acid residue (i.e., KITNSRPPL (SEQ ID NO: 172), KITNSRPPA (SEQ ID NO: 173), KITNSRPPG (SEQ ID NO: 174)); for peptide epitope K104 to V113 of SEQ ID NO:2 and FIG. 1B (i.e., KITNSRPPCV), the analogs with alanine, glycine, serine or leucine substituted for cysteine at the ninth amino acid residue (i.e., KITNSRPPLV (SEQ ID NO: 175), KITNSRPPAV (SEQ ID NO: 176), KITNSRPPGV (SEQ ID NO: 177), KITNSRPPSV (SEQ ID NO: 178)); for the peptide epitope I105 to V113 of SEQ ID NO:2 and FIG. 1B (i.e., ITNSRPPCV), the analogs wherein either leucine or methionine is substituted for threonine at the second amino acid residue and/or alanine, serine or glycine is substituted for cysteine at the eighth amino acid residue (i.e., ILNSRPPCV (SEQ ID NO: 179), IMNSRPPCV (SEQ ID NO: 180), ITNSRPPAV (SEQ ID NO: 181), ITNSRPPGV (SEQ ID NO: 182), ILNSRPPAV (SEQ ID NO: 183), ILNSRPPGV (SEQ ID NO: 184), IMNSRPPAV (SEQ ID NO: 185), IMNSRPPGV (SEQ ID NO: 186), ILNSRPPSV (SEQ ID NO: 187), IM NSRPPSV (SEQ ID NO: 188), ITNSRPPSV (SEQ ID NO: 189)), for the peptide epitope N107 to L115 of SEQ ID NO:2 and FIG. 1B (i.e., NSRPPCVIL), the analog with either alanine or glycine substituted for cysteine at the sixth amino acid residue (i.e., NSRPPAVIL (SEQ ID NO: 190), NSRPPGVIL (SEQ ID NO: 191)), and at least one C35 peptide epitope selected from the group consisting of: amino acids E4 to P12 of SEQ ID NO:2, S9 to V17 of SEQ ID NO: 2, S21 to Y29 of SEQ ID NO:2, G22 to C30 of SEQ ID NO: 2, I25 to C33 of SEQ ID NO:2, T38 to V46 of SEQ ID NO:2, G61 to I69 of SEQ ID NO:2, T62 to N70 of SEQ ID NO:2, G63 to G71 of SEQ ID NO:2, F65 to L73 of SEQ ID NO: 2, I67 to F75 of SEQ ID NO:2, K77 to Y85 of SEQ ID NO:2, Q72 to E86 of SEQ ID NO:2, G81 to L89 of SEQ ID NO:2, G99 to V113 of SEQ ID NO:2, E100 to V113 of SEQ ID NO:2, K104 to C112 of SEQ ID NO:2, K104 to V113 of SEQ ID NO: 2, I105 to V113 of SEQ ID NO:2, and N107 to L115 of SEQ ID NO:2.

Thus, one strategy to improve the cross-reactivity of peptides within a given supermotif is simply to delete one or more of the deleterious residues present within a peptide and substitute a small "neutral" residue such as Ala (that may not influence T cell recognition of the peptide). An enhanced likelihood of cross-reactivity is expected if, together with elimination of detrimental residues within a peptide, "preferred" residues associated with high affinity binding to an allele-specific HLA molecule or to multiple HLA molecules within a superfamily are inserted.

To ensure that an analog peptide, when used as a vaccine, actually elicits a CTL response to the native epitope in vivo (or, in the case of class II epitopes, elicits helper T cells that cross-react with the wild type peptides), the analog peptide may be used to induce T cells in vitro from individuals of the appropriate HLA allele. Thereafter, the immunized cells' capacity to lyse wild type peptide sensitized target cells is evaluated. Alternatively, evaluation of the cells' activity can be evaluated by monitoring IFN release. Each of these cell monitoring strategies evaluate the recognition of the APC by the CTL. It will be desirable to use as antigen presenting cells, cells that have been either infected, or transfected with the appropriate genes, or, (generally only for class II epitopes, due to the different peptide processing pathway for HLA class II), cells that have been pulsed with whole protein antigens, to establish whether endogenously produced antigen is also recognized by the T cells induced by the analog peptide. It is to be noted that peptide/protein-pulsed dendritic cells can be used to present whole protein antigens for both HLA class I and class II.

Another embodiment of the invention is to create analogs of weak binding peptides, to thereby ensure adequate numbers of cellular binders. Class I binding peptides exhibiting binding affinities of 500-5000 nM, and carrying an acceptable but suboptimal primary anchor residue at one or both positions can be "fixed" by substituting preferred anchor residues in accordance with the respective supertype. The analog peptides can then be tested for binding and/or cross-binding capacity.

Another embodiment of the invention is to create analogs of peptides that are already cross-reactive binders and are vaccine candidates, but which bind weakly to one or more alleles of a supertype. If the cross-reactive binder carries a suboptimal residue (less preferred or deleterious) at a primary or secondary anchor position, the peptide can be analoged by substituting out a deleterious residue and replacing it with a preferred or less preferred one, or by substituting out a less preferred residue and replacing it with a preferred one. The analog peptide can then be tested for cross-binding capacity.

Another embodiment for generating effective peptide analogs involves the substitution of residues that have an adverse impact on peptide stability or solubility in, e.g., a liquid environment. This substitution may occur at any position of the peptide epitope. For example, a cysteine (C) can be substituted out in favor of α-amino butyric acid. Due to its chemical nature, cysteine has the propensity to form disulfide bridges and sufficiently alter the peptide structurally so as to reduce binding capacity. Substituting α-amino butyric acid for C not only alleviates this problem, but actually improves binding and crossbinding capability in certain instances (see, e.g., the review by Sette et al., In: *Persistent Viral Infections*, Eds. R. Ahmed and I. Chen, John Wiley & Sons, England, 1999). Substitution of cysteine with α-amino butyric acid may occur at any residue of a peptide epitope, i.e. at either anchor or non-anchor positions.

Moreover, it has been shown that in sets of A*0201 motif-bearing peptides containing at least one preferred secondary anchor residue while avoiding the presence of any deleterious secondary anchor residues, 69% of the peptides will bind A*0201 with an $IC_{50}$ less than 500 nM (Ruppert, J. et al. *Cell* 74:929, 1993). The determination of what was a preferred or deleterious residue in Ruppert can be used to generate algorithms (see, e.g., 22). Such algorithms are flexible in that cut-off scores may be adjusted to select sets of peptides with greater or lower predicted binding properties, as desired.

C35 epitopes containing cysteine residues have a tendency to dimerize with other cysteine containing peptides. Thus, an embodiment of the present invention is a composition comprising a peptide epitope of the invention (e.g. a C35 peptide epitope listed in any of Tables 1-3 or 5-6, exclusive of E100 to R109 of SEQ ID NO:2) and a suitable reducing agent that protects the free sulfhydryl group of the cysteine residue but does not otherwise inhibit epitope binding. In a preferred embodiment the composition comprises the peptide epitope ITNSRPPCV (I105 to V113 of SEQ ID NO:2) or KITNSRPPCV (K104 to V113 of SEQ ID NO:2) in combination with a suitable reducing agent. Suitable reducing agents include, but are not limited to, TCEP and dithiothreitol (DTT).

Another embodiment of the invention is to create peptide epitope analogs in which the cysteine residues of the peptide epitope (e.g., a C35 peptide epitope listed in any of Tables 1-3 or 5-6, exclusive of E100 to R109 of SEQ ID NO:2) have been substituted with any other amino acid to facilitate synthesis. (See Zarling, A. L. et al., *J. Exp. Med.* 192(12): 1755-1762 (2000)). Preferably, the cysteine residues are substituted with either alanine, serine or glycine residues, although any amino acid can be substituted provided that such substitution does not negatively effect binding to MHC or recognition by T cells. Thus, in a particularly preferred embodiment, the isolated polypeptides of the present invention comprise or, alternatively, consist of the following C35 peptide epitope analogs: for the peptide epitope G22 to C30 of SEQ ID NO:2 and FIG. 1B (i.e., GVRIVVEYC), the analog with either alanine or glycine substituted for the cysteine at the ninth amino acid residue (i.e., GVRIVVEYA (SEQ ID NO: 161) or GVRIVVEYG (SEQ ID NO: 162)); for the peptide epitope I25 to C33 of SEQ ID NO:2 and FIG. 1B (i.e., IVVEYCEPC), the analog with either alanine or glycine substituted for the cysteine at the sixth amino acid residue and/or the ninth amino acid residue (i.e., IVVEYAEPC (SEQ ID NO: 163) or IVVEYGEPC (SEQ ID NO: 164) or IVVEYCEPA (SEQ ID NO: 165) or IVVEYCEPG (SEQ ID NO: 166) or IVVEYAEPA (SEQ ID NO: 167) or IVVEYAEPG (SEQ ID NO: 168) or IVVEYGEPA (SEQ ID NO: 169) or IVVEYGEPG (SEQ ID NO: 170)); for the peptide epitope of K104 to C112 of SEQ ID NO:2 and FIG. 1B (i.e., KITNSRPPC) the analog with either alanine or glycine substituted for the cysteine at the ninth residue (i.e., KITNSRPPA (SEQ ID NO: 171) or KITNSRPPG (SEQ ID NO: 172)); for the peptide epitope K104 to V113 of SEQ ID NO:2 and FIG. 1B (i.e., KITNSRPPCV), the analog with either alanine, serine or glycine substituted for the cysteine at the ninth residue (i.e., KITNSRPPAV (SEQ ID NO: 173), KITNSRPPSV (SEQ ID NO: 174) or KITNSRPPGV (SEQ ID NO: 175)); for the peptide epitope I105 to V113 of SEQ ID NO:2 and FIG. 1B (i.e., ITNSRPPCV), the analog with either alanine, serine or glycine substituted for the cysteine at the eighth residue (i.e., ITNSRPPAV (SEQ ID NO: 176), ITNSRPPSV (SEQ ID NO: 177) or ITNSRPPGV (SEQ ID NO: 178)); for the peptide epitope N107 to L115 (i.e., NSRPPCVIL), the analog with either alanine or glycine substituted for the cysteine at the sixth amino acid residue (i.e., NSRPPAVIL (SEQ ID NO: 190), NSRPPGVIL (SEQ ID NO: 191)); for the multi-epitope peptide T101 to V113 of SEQ ID NO:2 and FIG. 1B (i.e., TLEKITNSRPPCV), the analog with either alanine or glycine substituted for the cysteine at the twelfth residue (i.e., TLEKITNSRPPAV (SEQ ID NO: 192) or TLEKITNSRPPGV (SEQ ID NO: 193)); for the multi-epitope peptide E100 to V113 of SEQ ID NO:2 and FIG. 1B (i.e., ETLEKITNSRPPCV), the analog with either alanine or glycine substituted for the cysteine at the thirteenth amino acid residue (i.e., ETLEKITNSRPPAV (SEQ ID NO: 194), ETLEKITNSRPPGV (SEQ ID NO: 195)), for the multi-epitope peptide G99 to V113 of SEQ ID NO:2 and FIG. 1B (i.e., GETLEKITNSRPPCV), the analog with either alanine or glycine substituted for the cysteine at the fourteenth amino acid residue (i.e., GETLEKITNSRPPAV (SEQ ID NO: 196)), GETLEKITNSRPPGV (SEQ ID NO: 197)), for the multi-epitope peptide I93 to V113 of SEQ ID NO:2 and FIG. 1B (i.e., IRRASNGETLEKITNSRPPCV), the analog with either alanine or glycine substituted for the cysteine at the twentieth residue (i.e., IRRASNGETLEKITNSRPPAV (SEQ ID NO: 198)) or IRRASNGETLEKITNSRPPGV (SEQ ID NO: 199)); for the multi-epitope peptide D88 to V113 of SEQ ID NO:2 and FIG. 1B (i.e., DLIEAIRRASNGETLEKITNSRPPCV), the analog with either alanine or glycine substituted for the cysteine at the twenty-fifth residue (i.e., DLIEAIRRASNGETLEKITNSRPPAV (SEQ ID NO: 200) or DLIEAIRRASNGETLEKITNSRPPGV (SEQ ID NO: 201)); for the multi-epitope peptide P84 to V113 of SEQ ID NO:2 and FIG. 1B (i.e., PYEKDLIEAIRRASNGETLEKITNSRPPCV, the analog with either alanine or glycine substituted for the cysteine at the twenty-ninth residue (i.e., PYEKDLIEAIRRASNGETLEKITNSRPPAV (SEQ ID NO: 202)) or PYEKDLIEAIRRASNGETLEKITNSRPPGV (SEQ ID NO: 203)); for the multi-epitope peptide K77 to L115 of SEQ ID NO:2 and FIG. 1B (i.e., KLENGGFPYEKDLIEAIRRASNGETLEKITNSRPPCV), the analog with either alanine or glycine substituted for the cysteine at the thirty-sixth residue (i.e., KLENGGFPYEKDLIEAIRRASNGETLEKITNSRPPAV (SEQ ID NO: 204)) or KLENGGFPYEKDLIEAIRRASNGETLEKITNSRPPGV (SEQ ID NO: 205)); for the multi-epitope peptide Q72 to L115 of SEQ ID NO:2 and FIG. 1B (i.e., QLVFSKLENGGFPYEKDLIEAIRRASNGETLEKITNSRPPCV), the analog with either alanine or glycine substituted for the cysteine at the forty-first residue (i.e., QLVFSKLENGGFPYEKDLIEAIRRASNGETLEKITNSRPPAV (SEQ ID NO: 206) or QLVFSKLENGGFPYEKDLIEAIRRASNGETLEKITNSRPPGV (SEQ ID NO: 207)); for the multi-epitope peptide F65 to L115 of SEQ ID NO:2 and FIG. 1B (i.e., FEIEINGQLVFSKLENGGFPYEKDLIEAIRRASNGETLEKITNSRPPCV), the analog with either alanine or glycine substituted for the cysteine at the forty-eighth residue (i.e., FEIEINGQLVFSKLENGGFPYEKDLIEAIRRASNGETLEKITNSRPPAV (SEQ ID NO: 208)) or FEIEINGQLVFSKLENGGFPYEKDLIEAIRRASNGETLEKITNSRPPGV (SEQ ID NO: 209)); and for the multi-epitope peptide L59 to L115 of SEQ ID NO:2 and FIG. 1B (i.e., LGGTGAFEIEINGQLVFSKLENGGFPYEKDLIEAIRRASNGETLEKITNS RPPCV), the analog with either alanine or glycine substituted for the cysteine at the fifty-fourth residue (i.e., LGGTGAFEIEINGQLVFSKLENGGFPYEKDLIEAIRRASNGETLEKITNS RPPAV (SEQ ID NO: 210)) or LGGTGAFEIEINGQLVFSKLENGGFPYEKDLIEAIRRASNGETLEKITNS RPPGV (SEQ ID NO. 211)).

Another embodiment of the invention is to create peptide epitope analogs in which the cysteine residues of the peptide epitope (e.g., a C35 peptide epitope listed in any of Tables 1-3 or 5-6, exclusive of E100 to R109 of SEQ ID NO:2, having one or more cysteine residues) have been "cysteinylated" (i.e., reacted with a second cysteine residue). (See Pierce, R. A. et al., *J. Immunol.* 163(12):6360-6364 (1999)). As used herein, the term "cysteinylated" describes a cysteine residue, within a peptide (e.g. peptide epitope) of the present invention, which has been reacted with a second free cysteine, i.e. a cysteine not part of a larger peptide, at the free sulfhydryl group thereby creating a disulfide bond (—SH+HS—=—S—S—).

Thus, in a particularly preferred embodiment, the isolated polypeptides of the present invention comprise or, alternatively, consist of the following C35 peptide epitope analogs: for the peptide epitope of K104 to V113 of SEQ ID NO:2 and FIG. 1B (i.e., KITNSRPPCV), the analog wherein the cysteine at the ninth residue has been cysteinylated and for the peptide epitope of I105 to V113 of SEQ ID NO:2 and FIG. 1B (i.e. ITNSRPPCV), the analog wherein the cysteine at the eighth residue has been cysteinylated.

Another embodiment of the invention is to create peptide epitope analogs in which the serine, threonine and/or tyrosine residues of the peptide epitope (e.g., a C35 peptide epitope listed in any of Tables 1-3 or 5-6, exclusive of E100 to R109 of SEQ ID NO:2) have been phosphorylated. Thus, in a particularly preferred embodiment, the isolated polypeptides of the present invention comprise or, alternatively, consist of the following C35 peptide epitope analogs: for the peptide epitope E4 to P12 of SEQ ID NO:2 and FIG. 1B (i.e., EPGQTSVAP), the analog wherein the threonine at T8 and/or the serine at S9 have been phosphorylated; for the peptide epitope S9 to V17 of SEQ ID NO:2 and FIG. 1B (i.e., SVAPPPEEV), the analog wherein the serine at S9 has been phosphorylated; for the peptide epitope S21 to Y29 of SEQ ID NO:2 and FIG. 1B (i.e., SGVRIVVEY), the analog wherein the serine at S21 and/or the tyrosine at Y29 are phosphorylated; for the peptide epitope G22 to C30 of SEQ ID NO:2 and FIG. 1B (i.e., GVRIVVEYC), the analog wherein the tyrosine at Y29 is phosphorylated; for the peptide epitope T38 to V46 of SEQ ID NO:2 and FIG. 1B (i.e., TYLELASAV), the analog wherein the threonine at T38, the tyrosine at Y39, and/or the serine at S44 are phosphorylated; for the peptide epitope G61 to I69 (i.e., GTGAFEIEI), the analog wherein the threonine at T62 is phosphorylated); for the peptide epitope T62 to N70 of SEQ ID NO:2 and FIG. 1B (i.e., TGAFEIEIN), the analog wherein the threonine at T62 has been phosphorylated; for the peptide epitope K77 to Y85 of SEQ ID NO:2 and FIG. 1B (i.e., KLENGGFPY), the analog wherein the tyrosine at Y85 is phosphorylated; for the peptide epitope Q72 to E86 of SEQ ID NO:2 and FIG. 1B (i.e., QLVFSKLENGGFPYE), the analog wherein the serine at S76 and/or the tyrosine at Y85 are phosphorylated; for the peptide epitope G81 to L89 of SEQ ID NO:2 or FIG. 1B (i.e., GGFPYEKDL), the analog wherein the tyrosine at Y85 is phosphorylated; for the peptide epitope K104 to C112 of SEQ ID NO:2 and FIG. 1B (i.e., KITNSRPPC), the analog wherein the threonine at T106 and/or the serine at S108 are phosphorylated; for the peptide epitope K104 to V113 of SEQ ID NO:2 and FIG. 1B (i.e., KITNSRPPCV), the analog wherein the threonine at T106 and/or the serine at S108 are phosphorylated; for the peptide epitope I105 to V113 (i.e., ITNSRPPCV), the analog wherein the threonine at T106 and/or the serine at S108 are phosphorylated; for the peptide epitope N107 to L115 (i.e., NSRPPCVIL), the analog wherein the serine at S108 is phosphorylated; for the polyepitopic peptide T101 to V113 of SEQ ID NO:2 and FIG. 1B (i.e., TLEKITNSRPPCV), the analog wherein the threonines at T101 and T106 and/or the serine at S108 are phosphorylated; for the polyepitopic peptide I93 to V113 of SEQ ID NO:2 and FIG. 1B (i.e., IRRASNGETLEKITNSRPPCV), the analog wherein the serine at S97 and/or the threonine at T101 and/or the threonine at T106 and/or the serine at S108 are phosphorylated; for the polyepitopic peptide D88 to V113 of SEQ ID NO:2 and FIG. 1B (i.e., DLIEAIRRASNGETLEKITNSRPPCV), the analog wherein the serine at S97 and/or the threonine at T101 and/or the threonine at T106 and/or the serine at S108 are phosphorylated; for the polyepitopic peptide P84 to V113 of SEQ ID NO:2 and FIG. 1B (i.e., PYEKDLIEAIRRASNGETLEKITNSRPPCV), the analog wherein the tyrosine at Y85 and/or the serine at S97 and/or the threonine at T101 and/or the threonine at T106 and/or the serine at S108 are phosphorylated; for the polyepitopic peptide K77 to V113 of SEQ ID NO:2 and FIG. 1B (i.e., KLENGGFPYEKDLIEAIRRASNGETLEKITNSRPPCV), the analog wherein the tyrosine at Y85 and/or the serine at S97 and/or the threonine at T101 and/or the threonine at T106 and/or the serine at S108 are phosphorylated; for the polyepitopic peptide Q72 to V113 of SEQ ID NO:2 and FIG. 1B (i.e., QLVFSKLENGGFPYEKDLIEAIRRASNGETLEKITNSRPPCV), the analog wherein the serine at S76 and/or the tyrosine at Y85 and/or the serine at S97 and/or the threonine at T101 and/or the threonine at T106 and/or the serine at S108 are phosphorylated; for the polyepitopic peptide F65 to V113 of SEQ ID NO:2 and FIG. 1B (i.e., FEIEINGQLVFSKLENGGFPYEKDLIEAIRRASNGETLEKITNSRPPCV), the analog wherein the serine at S76 and/or the tyrosine at Y85 and/or the serine at S97 and/or the threonine at T101 and/or the threonine at T106 and/or the serine at S108 are phosphorylated; for the polyepitopic peptide L59 to V113 of SEQ ID NO:2 and FIG. 1B (i.e., LGGTGAFEIEINGQLVFSKLENGGFPYEKDLIEAIRRASNGETLEKITNS RPPCV), the analog wherein the threonine at T62 and/or the serine at S76 and/or the tyrosine at Y85 and/or the serine at S97 and/or the threonine at T101 and/or the threonine at T106 and/or the serine at S108 are phosphorylated.

Another embodiment of the invention is to create peptide epitope analogs in which the asparagine residues of the peptide epitope (e.g., a C35 peptide epitope listed in any of Tables 1-3 or 5-6, exclusive of E100 to R109 of SEQ ID NO:2) have been converted to aspartic acid after translation. (See Skipper, J. C. et al., *J. Exp. Med.* 183(2):527-534 (1996)).

In preferred embodiments, the C35 peptide epitope analogs of the present invention contain multiple modifications provided that such modifications do not inhibit binding to MHC molecules or recognition by T cells. Thus, preferred analogs include C35 peptide epitopes for which one or more residues have been modified as described herein to increase binding affinity to MHC molecules, one or more cysteine residues have been replaced with alanine or glycine residues to facilitate synthesis, and one or more serine, threonine or tyrosine residues have been phosphorylated.

Furthermore, additional amino acids can be added to the termini of a peptide epitope to provide for ease of linking peptide epitopes one to another, for coupling to a carrier support or larger polypeptide, for modifying the physical or chemical properties of the peptide or oligopeptide, or the like. Amino acids such as tyrosine, cysteine, lysine, glutamic or aspartic acid, or the like, can be introduced at the C- or N-terminus of the peptide or oligopeptide, particularly class I peptides. It is to be noted that modification at the carboxyl terminus of a CTL epitope may, in some cases, alter binding characteristics of the peptide. In addition, the peptide or oligopeptide sequences can differ from the natural sequence by being modified by terminal-$NH_2$ acylation, e.g., by alkanoyl ($C_1$-$C_{20}$) or thioglycolyl acetylation, terminal-carboxylamidation, e.g., ammonia, methylamine, etc., polyethylene-glycol modification (i.e., PEGylation) of the C-terminus, and the addition of a lipid tail (e.g., a palmitoyl-lysine chain) to enhance presentation to T cells and immunogenicity. (See Brinckerhoff, L. H. et al., *Int. J. Cancer* 83(3):326-334 (1999); Le Gal, F. A. et al., *Int. J. Cancer* 98(2):221-227 (2002). N-terminal amides, in particular, will be more resistant to certain peptidases, thus preventing destruction of the peptide epitope in situ without affecting recognition. This will effectively increase the half-life of the peptide epitope and enhance its ability to stimulate immune cells. In some instances these modifications may provide sites for linking to a support or other molecule.

Preparation of Peptide Epitopes

Peptide epitopes in accordance with the invention can be prepared synthetically, by recombinant DNA technology or chemical synthesis, or from natural sources such as native tumors or pathogenic organisms. Peptide epitopes may be synthesized individually or as polyepitopic polypeptides (e.g., homopolymers or heteropolymers). Although the peptide will preferably be substantially free of other naturally occurring host cell proteins and fragments thereof, in some embodiments the peptides may be synthetically conjugated to native fragments or particles.

In addition, one or more non-C35 tumor associated peptides can be linked to one or more C35 peptide epitopes and/or C35 peptide epitope analogs to increase immune response via HLA class I and/or class II. Especially preferred are polypeptides comprising a series of epitopes, known as "polytopes," and nucleic acids encoding same. The epitopes can be arranged in sequential or overlapping fashion (see, e.g., Thomson et al., *Proc. Natl. Acad. Sci. USA* 92:5845-5849 (1995); Gilbert et al., *Nature/Biotechnology* 15:1280-1284 (1997)), with or without the natural flanking sequences, and can be separated by unrelated linker sequences if desired. The polytope is processed to generate individual epitopes which are recognized by the immune system for generation of immune responses.

Thus, for example, C35 peptide epitopes and C35 peptide epitope analogs can be combined with peptides from other tumor rejection antigens (e.g., by preparation of hybrid nucleic acids or polypeptides) to form "polytopes." (Zeng, G. et al., *Proc. Natl. Acad. Sci.* 98(7):3964-3969 (2001); Zeng, G. et al., *J. Immunol.* 165:1153-1159 (2000); Mancini, S. et al., *J. Exp. Med.* 189(5):871-876 (1999)). Exemplary tumor associated antigens that can be administered to induce or enhance an immune response are derived from tumor associated genes and encoded proteins including: MAGE-1, MAGE-2, MAGE-3, MAGE-4, MAGE-5, MAGE-6, MAGE-7, MAGE-8, MAGE-9, MAGE-10, MAGE-11, MAGE-12, MAGE-13, GAGE-1, GAGE-2, GAGE-3, GAGE-4, GAGE-5, GAGE-6, GAGE-7, GAGE-8, BAGE-1, RAGE-1, LB33/MUM-1, PRAME, NAG, MAGE-Xp2 (MAGE-B2), MAGE-Xp3 (MAGE-B3), MAGE-Xp4 (MAGE-B4), tyrosinase, brain glycogen phosphorylase, Melan-A, MAGE-C1, MAGE-C2, NY-ESO-1, LAGE-1, SSX-1, SSX-2(HOM-MEL-40), SSX-1, SSX-4, SSX-5, SCP-1 and CT-7. For example, specific antigenic peptides characteristic of tumors include those listed in Table A.

TABLE A

| Gene | MHC | Peptide | Position | SEQ ID NO: |
|---|---|---|---|---|
| MAGE-1 | HLA-A1 | EADPTGHSY | 161-169 | 212 |
| | HLA-Cw16 | SAYGEPRKL | 230-238 | 213 |
| MAGE-3 | HLA-A1 | EVDPIGHLY | 168-176 | 214 |
| | HLA-A2 | FLWGPRALV | 271-279 | 215 |
| | HLA-B44 | MEVDPIGHLY | 167-176 | 216 |
| BAGE | HLA-Cw16 | AARAVFLAL | 2-10 | 217 |
| GAGE-1,2 | HLA-Cw16 | YRPRPRRY | 9-16 | 218 |
| RAGE | HLA-B7 | SPSSNRIRNT | 11-20 | 219 |
| GnT-V | HLA-A2 | VLPDVFIRC(V) | 2-10/11 | 220 |
| MUM-1 | HLA-B44 | EEKLIVVLF | exon 2/intron | 221 |
| | | EEKLSVVLF | (wild-type) | 222 |
| CDK4 | HLA-A2 | ACDPHSGHFV | 23-32 | 223 |
| | | ARDPHSGHFV | (wild-type) | 224 |
| β-catenin | HLA-A24 | SYLDSGIHF | 29-37 | 225 |
| | | SYLDSGIHS | (wild-type) | 226 |
| Tyrosinase | HLA-A2 | MLLAVLYCL | 1-9 | 227 |
| | HLA-A2 | YMNGTMSQV | 369-377 | 228 |
| | HLA-A2 | YMDGTMSQV | 369-377 | 229 |
| | HLA-A24 | AFLPWHRLF | 206-214 | 230 |
| | HLA-B44 | SEIWRDIDF | 192-200 | 231 |
| | HLA-B44 | YEIWRDIDF | 192-200 | 232 |
| | HLA-DR4 | QNILLSNAPLGPQFP | 56-70 | 233 |
| | HLA-DR4 | DYSYLQDSDPDSFQD | 448-462 | 234 |
| Melan-$A^{Mart1}$ | HLA-A2 | (E)AAGIGILTV | 26/27-35 | 235 |
| | HLA-A2 | ILTVILGVL | 32-40 | 236 |
| gp$100^{Pmel17}$ | HLA-A2 | KTWGQYWQV | 154-162 | 237 |
| | HLA-A2 | ITDQVPFSV | 209-217 | 238 |
| | HLA-A2 | YLEPGPVTA | 280-288 | 239 |
| | HLA-A2 | LLDGTATLRL | 457-466 | 240 |
| | HLA-A2 | VLYRYGSFSV | 476-485 | 241 |

TABLE A-continued

| Gene | MHC | Peptide | Position | SEQ ID NO: |
|---|---|---|---|---|
| PRAME | HLA-A24 | LYVDSLFFL | 301-309 | 242 |
| MAGE-6 | HLA-Cw16 | KISGGPRISYPL | 292-303 | 243 |
| NY-ESO-1 | HLA-A2 | SLLMWITQCFL | 157-167 | 244 |
| | HLA-A2 | SLLMWITQC | 157-165 | 245 |
| | HLA-A2 | QLSLLMWIT | 155-163 | 246 |

Other examples of non-C35 HLA class I and HLA class II binding peptides will be known to one of ordinary skill in the art and can be used in the invention in a like manner to those disclosed herein. One of ordinary skill in the art can prepare polypeptides comprising one or more C35 peptide epitopes or C35 peptide epitope analogs and one or more of the aforementioned tumor rejection peptides, or nucleic acids encoding such polypeptides, according to standard procedures in molecular biology. Examples of polytopes comprising C35 peptide epitopes or C35 peptide epitope analogs of the present invention and various tumor rejection antigenic peptides are set forth in Tables B and C below.

Thus, polytopes are groups of two or more potentially immunogenic or immune response stimulating peptides which can be joined together in various arrangements (e.g. concatenated, overlapping). The polytope (or nucleic acid encoding the polytope) can be administered in a standard immunization protocol, e.g. to animals, to test the effectiveness of the polytope in stimulating, enhancing and/or provoking an immune response. The peptides can be joined directly or via the use of flanking sequences to form polytopes, and the use of polytopes as vaccines is well known in the art.

In a preferred embodiment, the isolated polypeptides of the present invention comprise one or more C35 peptide epitopes or C35 peptide epitope analogs linked to one or more tumor rejection peptides. In a particularly preferred embodiment, said one or more C35 peptide epitopes are selected from the group consisting of: amino acids E4 to P12 of SEQ ID NO:2, amino acids S9 to V17 of SEQ ID NO:2, amino acids S21 to Y29 of SEQ ID NO:2, amino acids G22 to C30 of SEQ ID NO: 2, amino acids I25 to C33 of SEQ ID NO:2, amino acids T38 to V46 of SEQ ID NO:2, amino acids G61 to I69 of SEQ ID NO:2, amino acids T62 to N70 of SEQ ID NO:2, amino acids G63 to G71 of SEQ ID NO:2, amino acids F65 to L73 of SEQ ID NO:2, amino acids I67 to F75 of SEQ ID NO:2, amino acids K77 to Y85 of SEQ ID NO:2, amino acids Q72 to E86 of SEQ ID NO:2, amino acids G81 to L89 of SEQ ID NO:2, amino acids K104 to C112 of SEQ ID NO:2, amino acids K104 to V113 of SEQ ID NO:2, amino acids I105 to V113 of SEQ ID NO:2, amino acids N107 to L115 of SEQ ID NO:2, amino acids T101 to V113 of SEQ ID NO:2, amino acids E100 to V113 of SEQ ID NO:2, amino acids G99 to V113 of SEQ ID NO:2, amino acids I93 to V113 of SEQ ID NO:2, amino acids D88 to V113 of SEQ ID NO:2, amino acids P84 to V113 of SEQ ID NO:2, amino acids K77 to V113 of SEQ ID NO:2, amino acids Q72 to V113 of SEQ ID NO:2, amino acids F65 to V113 of SEQ ID NO:2, and L57 to V113 of SEQ ID NO:2; and said one or more tumor rejection peptides are selected from the group consisting of the antigenic peptides shown in Table A.

In another embodiment, one or more non-C35 cell penetrating peptides can be linked to one or more C35 peptide epitopes and/or C35 peptide epitope analogs to enhance delivery of C35 peptide epitopes to cells, e.g., dendritic cells. Especially preferred are polypeptides comprising a series of C35 peptide epitopes or C35 peptide epitope analogs and cell penetrating peptides, and nucleic acids encoding same. The epitopes and peptides can be arranged in sequential or overlapping fashion with or without the natural flanking sequences, and can be separated by unrelated linker sequences if desired. The polypeptide is processed to generate individual C35 epitopes which are recognized by the immune system for generation of immune responses.

Thus, for example, C35 peptide epitopes and C35 peptide epitope analogs can be combined with cell-penetrating peptides. (Wang, R.-F. et al., *Nature Biotechnology* 20(2):149-154 (2002); Frankel, A. D. et al., *Cell* 55:1189-1193 (1988); Elliott, G. et al., *Cell* 88(2):223-233 (1997); Phelan, A. et al., *Nature Biotechnology* 16(5):440-443 (1998); Lin, Y.-Z. et al., *J. Biol. Chem.* 270(24):14255-14258 (1995); Rojas, M. et al., *Nature Biotechnology* 16(4):370-375 (1998)). Exemplary cell penetrating peptides that can be administered to enhance delivery of C35 peptides to cells, such as dendritic cells, include: the Tat protein of human immunodeficiency virus, the HSV-1 structural protein VP22, and the 12-residue membrane-translocating sequence (MTS) modified from the 16-residue h region of the signal sequence of Kaposi fibroblast growth factor.

The one or more C35 peptide epitopes/analogs and one or more cell penetrating peptides can be joined together in various arrangements (e.g. concatenated, overlapping). The resulting polypeptide (or nucleic acid encoding the polypeptide) can be administered in a standard immunization protocol, e.g. to animals, to test the effectiveness of the polypeptide in stimulating, enhancing and/or provoking an immune response. The C35 peptide epitopes/analogs and one or more cell penetrating peptides can be joined directly or via the use of flanking sequences to form the polypeptides, and the use of such polypeptides as vaccines is well known in the art. Examples of polypeptides comprising C35 peptide epitopes or C35 peptide epitope analogs of the present invention and various cell penetrating peptides are set forth in Tables D and E below.

TABLE B

| C35 Peptide/Epitope | Exemplary Tumor Rejection Peptide | Exemplary Polytopes |
|---|---|---|
| S9-V17 of SEQ ID NO: 2 SVAPPPEEV | amino acids 161-169 of MAGE-1 | **SVAPPPEEV**EADPTGHSY (SEQ ID NO: 247),<br>EADPTGHSYSVAAPPPEEVEADPTGHSY (SEQ ID NO: 248) |
| | amino acids 230-238 of MAGE-1 | **SVAPPPEEV**SAYGEPRKL (SEQ ID NO: 249),<br>SAYGEPRKL **SVAPPPEEV**SAYGEPRKL (SEQ ID NO: 250) |
| | amino acids 168-176 of MAGE-3 | **SVAPPPEEV**EVDPIGHLY (SEQ ID NO: 251),<br>EVDPIGHLY**SVAPPPEEV**EVDPIGHLY (SEQ ID NO: 252) |
| | amino acids 271-279 of MAGE-3 | **SVAPPPEEV**FLWGPRALV (SEQ ID NO: 253),<br>FLWGPRALV**SVAPPPEEV**FLWGPRALV (SEQ ID NO: 254) |
| | amino acids 167-176 of MAGE-3 | **SVAPPPEEV**MEVDPIGHLY (SEQ ID NO: 255),<br>MEVDPIGHLY**SVAPPPEEV**MEVDPIGHLY (SEQ ID NO: 256) |
| | amino acids 2-10 of BAGE | **SVAPPPEEV**AARAVFLAL (SEQ ID NO: 257),<br>AARAVFLAL**SVAPPPEEV**AARAVFLAL (SEQ ID NO: 258) |
| | amino acids 9-16 of GAGE-1,2 | **SVAPPPEEV**YRPRPRRY (SEQ ID NO: 259),<br>YRPRPRRY**SVAPPPEEV**YRPRPRRY (SEQ ID NO: 260) |
| | amino acids 11-20 of RAGE | **SVAPPPEEV**SPSSNRIRNT (SEQ ID NO: 261),<br>SPSSNRIRNT**SVAPPPEEV**SPSSNRIRNT (SEQ ID NO: 262) |
| | amino acids 23-32 of CDK4 | **SVAPPPEEV**ARDPHSGHFV (SEQ ID NO: 263),<br>ARDPHSGHFV**SVAPPPEEV**ARDPHSGHFV (SEQ ID NO: 264) |
| | amino acids 29-37 of β-catenin | **SVAPPPEEV**SYLDSGIHS (SEQ ID NO: 265),<br>SYLDSGIHS**SVAPPPEEV**SYLDSGIHS (SEQ ID NO: 266) |
| | amino acids 1-9 of Tyrosinase | **SVAPPPEEV**MLLAVLYCL (SEQ ID NO: 267),<br>MLLAVLYCL**SVAPPPEEV**MLLAVLYCL (SEQ ID NO: 268) |
| | amino acids 206-214 of Tyrosinase | **SVAPPPEEV**AFLPWHRLF (SEQ ID NO: 269),<br>AFLPWHRLF**SVAPPPEEV**AFLPWHRLF (SEQ ID NO: 270) |
| | amino acids 56-70 of Tyrosinase | **SVAPPPEEV**QNILLSNAPLGPQFP (SEQ ID NO: 271),<br>QNILLSNAPLGPQFP**SVAPPPEEV**QNILLSNAPLGPQFP (SEQ ID NO: 272) |
| | amino acids 448-462 of Tyrosinase | **SVAPPPEEV**DYSYLQDSDPDSFQD (SEQ ID NO: 273),<br>DYSYLQDSDPDSFQD**SVAPPPEEV**DYSYLQDSDPDSFQD (SEQ ID NO: 274) |
| | amino acids 32-40 of Melan-$A^{MART-1}$ | **SVAPPPEEV**JLTVILGVL (SEQ ID NO: 275),<br>JLTVILGVL**SVAPPPEEV**JLTVILGVL (SEQ ID NO: 276) |
| | amino acids 154-162 of $gp100^{Pmel17}$ | **SVAPPPEEV**KTWGQYWQV (SEQ ID NO: 277),<br>KTWGQYWQV**SVAPPPEEV**KTWGQYWQV (SEQ ID NO: 278) |

TABLE B-continued

| C35 Peptide/Epitope | Exemplary Tumor Rejection Peptide | Exemplary Polytopes |
|---|---|---|
| | amino acids 209-217 of gp100$^{Pmel17}$ | **SVAPPPEEV**ITDQVPFSV (SEQ ID NO: 279),<br>ITDQVPFSV**SVAPPPEEV**ITDQVPFSV (SEQ ID NO: 280) |
| | amino acids 280-288 of gp100$^{Pmel17}$ | **SVAPPPEEV**YLEPGPVTA (SEQ ID NO: 281),<br>YLEPGPVTA**SVAPPPEEV**YLEPGPVTA (SEQ ID NO: 282) |
| | amino acids 457-466 of gp100$^{Pmel17}$ | **SVAPPPEEV**LLDGTATLRL (SEQ ID NO: 283),<br>LLDGTATLRL**SVAPPPEEV**LLDGTATLRL (SEQ ID NO: 284) |
| | amino acids 476-485 of gp100$^{Pmel17}$ | **SVAPPPEEV**VLYRYGSFSV (SEQ ID NO: 285),<br>VLYRYGSFSV**SVAPPPEEV**VLYRYGSFSV (SEQ ID NO: 286) |
| | amino acids 301-309 of PRAME | **SVAPPPEEV**LYVDSLFFL (SEQ ID NO: 287),<br>LYVDSLFFL**SVAPPPEEV**LYVDSLFFL (SEQ ID NO: 288) |
| | amino acids 292-303 of MAGE-6 | **SVAPPPEEV**KISGGPRISYPL (SEQ ID NO: 289),<br>KISGGPRISYPL**SVAPPPEEV**KISGGPRISYPL (SEQ ID NO: 290) |
| | amino acids 157-167 of NY-ESO-1 | **SVAPPPEEV**SLLMWITQCFL (SEQ ID NO: 291),<br>SLLMWITQCFL**SVAPPPEEV**SLLMWITQCFL (SEQ ID NO: 292) |
| | amino acids 157-165 of NY-ESO-1 | **SVAPPPEEV**SLLMWITQC (SEQ ID NO: 293),<br>SLLMWITQC**SVAPPPEEV**SLLMWITQC (SEQ ID NO: 294) |
| | amino acids 155-163 of NY-ESO-1 | **SVAPPPEEV**QLSLLMWIT (SEQ ID NO: 295),<br>QLSLLMWIT**SVAPPPEEV**QLSLLMWIT (SEQ ID NO: 296) |
| | amino acids 157-170 of NY-ESO-1 and amino acids 281-295 of MAGE-3 | SLLMWITQCFLPVF**SVAPPPEEV**TSYVKVLHHMVKISG (SEQ ID NO: 297) |
| S21-Y29 of SEQ ID NO: 2<br>SGVRIVVEY | amino acids 161-169 of MAGE-1 | **SGVRIVVEY**EADPTGHSY (SEQ ID NO: 298),<br>EADPTGHSY**SGVRIVVEY**EADPTGHSY (SEQ ID NO: 299) |
| | amino acids 230-238 of MAGE-1 | **SGVRIVVEY**SAYGEPRKL (SEQ ID NO: 300),<br>SAYGEPRKL**SGVRIVVEY**SAYGEPRKL (SEQ ID NO: 301) |
| | amino acids 168-176 of MAGE-3 | **SGVRIVVEY**EVDPIGHLY (SEQ ID NO: 302),<br>EVDPIGHLY**SGVRIVVEY**EVDPIGHLY (SEQ ID NO: 303) |
| | amino acids 271-279 of MAGE-3 | **SGVRIVVEY**FLWGPRALV (SEQ ID NO: 304),<br>FLWGPRALV**SGVRIVVEY**FLWGPRALV (SEQ ID NO: 305) |
| | amino acids 167-176 of MAGE-3 | **SGVRIVVEY**MEVDPIGHLY (SEQ ID NO: 306),<br>MEVDPIGHLY**SGVRIVVEY**MEVDPIGHLY (SEQ ID NO: 307) |
| | amino acids 2-10 of BAGE | **SGVRIVVEY**AARAVFLAL (SEQ ID NO: 308),<br>AARAVFLAL**SGVRIVVEY**AARAVFLAL (SEQ ID NO: 309) |
| | amino acids 9-16 of GAGE-1,2 | **SGVRIVVEY**YRPRPRRY (SEQ ID NO: 310),<br>YRPRPRRY**SGVRIVVEY**YRPRPRRY (SEQ ID NO: 311) |

TABLE B-continued

| C35 Peptide/Epitope | Exemplary Tumor Rejection Peptide | Exemplary Polytopes |
|---|---|---|
| | amino acids 11-20 of RAGE | **SGVRIVVEY**SPSSNRIRNT (SEQ ID NO: 312), SPSSNRIRNT**SGVRIVVEY**SPSSNRIRNT (SEQ ID NO: 313) |
| | amino acids 23-32 of CDK4 | **SGVRIVVEY**ACDPHSGHFV (SEQ ID NO: 314), ACDPHSGHFV**SGVRIVVEY**ACDPHSGHFV (SEQ ID NO: 315) |
| | amino acids 29-37 of β-catenin | **SGVRIVVEY**SYLDSGIHF (SEQ ID NO: 316), SYLDSGIHF**SGVRIVVEY**SYLDSGIHF (SEQ ID NO: 317) |
| | amino acids 1-9 of tyrosinase | **SGVRIVVEY**MLLAVLYCL (SEQ ID NO: 318), MLLAVLYCL**SGVRIVVEY**MLLAVLYCL (SEQ ID NO: 319) |
| | amino acids 206-214 of tyrosinase | **SGVRIVVEY**AFLPWHRLF (SEQ ID NO: 320), AFLPWHRLF**SGVRIVVEY**AFLPWHRLF (SEQ ID NO: 321) |
| | amino acids 56-70 of tyrosinase | **SGVRIVVEY**QNILLSNAPLGPQFP (SEQ ID NO: 322), QNILLSNAPLGPQFP**SGVRIVVEY**QNILLSNAPLGPQFP (SEQ ID NO: 323) |
| | amino acids 448-462 of tyrosinase | **SGVRIVVEY**DYSYLQDSDPDSFQD (SEQ ID NO: 324), DYSYLQDSDPDSFQD**SGVRIVVEY**DYSYLQDSDPDSFQD (SEQ ID NO: 325) |
| | amino acids 32-40 of Melan-$A^{MART-1}$ | **SGVRIVVEY**JLTVILGVL (SEQ ID NO: 326), JLTVILGVL**SGVRIVVEY**JLTVILGVL (SEQ ID NO: 327) |
| | amino acids 154-162 of $gp100^{Pmel17}$ | **SGVRIVVEY**KTWGQYWQV (SEQ ID NO: 328), KTWGQYWQV**SGVRIVVEY**KTWGQYWQV (SEQ ID NO: 329) |
| | amino acids 209-217 of $gp100^{Pmel17}$ | **SGVRIVVEY** ITDQVPFSV (SEQ ID NO: 330), ITDQVPFSV **SGVRIVVEY** ITDQVPFSV (SEQ ID NO: 331) |
| | amino acids 280-288 of $gp100^{Pmel17}$ | **SGVRIVVEY**YLEPGPVTA (SEQ ID NO: 332), YLEPGPVTA**SGVRIVVEY**YLEPGPVTA (SEQ ID NO: 333) |
| | amino acids 457-466 of $gp100^{Pmel17}$ | **SGVRIVVEY**LLDGTATLRL (SEQ ID NO: 334), LLDGTATLRL**SGVRIVVEY**LLDGTATLRL (SEQ ID NO: 335) |
| | amino acids 476-485 of $gp100^{Pmel17}$ | **SGVRIVVEY**VLYRYGSFSV (SEQ ID NO: 336), VLYRYGSFSV**SGVRIVVEY**VLYRYGSFSV (SEQ ID NO: 337) |
| | amino acids 301-309 of PRAME | **SGVRIVVEY**LYVDSLFFL (SEQ ID NO: 338), LYVDSLFFL**SGVRIVVEY**LYVDSLFFL (SEQ ID NO: 339) |
| | amino acids 292-303 of MAGE-6 | **SGVRIVVEY**KISGGPRISYPL (SEQ ID NO: 340), KISGGPRISYPL**SGVRIVVEY**KISGGPRISYPL (SEQ ID NO: 341) |
| | amino acids 157-167 of NY-ESO-1 | **SGVRIVVEY**SLLMWITQCFL (SEQ ID NO: 342), SLLMWITQCFL**SGVRIVVEY**SLLMWITQCFL (SEQ ID NO: 343) |
| | amino acids 157-165 of NY-ESO-1 | **SGVRIVVEY**SLLMWITQC (SEQ ID NO: 344), SLLMWITQC**SGVRIVVEY**SLLMWITQC (SEQ ID NO: 345) |

TABLE B-continued

| C35 Peptide/Epitope | Exemplary Tumor Rejection Peptide | Exemplary Polytopes |
|---|---|---|
| | amino acids 155-163 of NY-ESO-1 | **SGVRIVVEY**QLSLLMWIT (SEQ ID NO: 346),<br>QLSLLMWIT**SGVRIVVEY**QLSLLMWIT (SEQ ID NO: 347) |
| | amino acids 157-170 of NY-ESO-1 and amino acids 281-295 of MAGE-3 | SLLMWITQCFLPVF**SGVRIVVEY**TSYVKVLHHMVKISG (SEQ ID NO: 348) |
| G22-C30 of SEQ ID NO: 2 GVRIVVEYC | amino acids 161-169 of MAGE-1 | **GVRIVVEYC**EADPTGHSY (SEQ ID NO: 349),<br>EADPTGHSY**GVRIVVEYC**EADPTGHSY (SEQ ID NO: 350) |
| | amino acids 230-238 of MAGE-1 | **GVRIVVEYC**SAYGEPRKL (SEQ ID NO: 351),<br>SAYGEPRKL**GVRIVVEYC**SAYGEPRKL (SEQ ID NO: 352) |
| | amino acids 168-176 of MAGE-3 | **GVRIVVEYC**EVDPIGHLY (SEQ ID NO: 353),<br>EVDPIGHLY**GVRIVVEYC**EVDPIGHLY (SEQ ID NO: 354) |
| | amino acids 271-279 of MAGE-3 | **GVRIVVEYC**FLWGPRALV (SEQ ID NO: 355),<br>FLWGPRALV**GVRIVVEYC**FLWGPRALV (SEQ ID NO: 356) |
| | amino acids 167-176 of MAGE-3 | **GVRIVVEYC**MEVDPIGHLY (SEQ ID NO: 357),<br>MEVDPIGHLY**GVRIVVEYC**MEVDPIGHLY (SEQ ID NO: 358) |
| | amino acids 2-10 of BAGE | **GVRIVVEYC**AARAVFLAL (SEQ ID NO: 359),<br>AARAVFLAL**GVRIVVEYC**AARAVFLAL (SEQ ID NO: 360) |
| | amino acids 9-16 of GAGE-1,2 | **GVRIVVEYC**YRPRPRRY (SEQ ID NO: 361),<br>YRPRPRRY**GVRIVVEYC**YRPRPRRY (SEQ ID NO: 362) |
| | amino acids 11-20 of RAGE | **GVRIVVEYC**SPSSNRIRNT (SEQ ID NO: 363),<br>SPSSNRIRNT**GVRIVVEYC**SPSSNRIRNT (SEQ ID NO: 364) |
| | amino acids 23-32 of CDK4 | **GVRIVVEYC**ACDPHSGHFV (SEQ ID NO: 365),<br>ACDPHSGHFV**GVRIVVEYC**ACDPHSGHFV (SEQ ID NO: 366) |
| | amino acids 29-37 of β-catenin | **GVRIVVEYC**SYLDSGIHF (SEQ ID NO: 367),<br>SYLDSGIHF**GVRIVVEYC**SYLDSGIHF (SEQ ID NO: 368) |
| | amino acids 1-9 of tyrosinase | **GVRIVVEYC**MLLAVLYCL (SEQ ID NO: 369),<br>MLLAVLYCL**GVRIVVEYC**MLLAVLYCL (SEQ ID NO: 370) |
| | amino acids 206-214 of tyrosinase | **GVRIVVEYC**AFLPWHRLF (SEQ ID NO: 371),<br>AFLPWHRLF**GVRIVVEYC**AFLPWHRLF (SEQ ID NO: 372) |
| | amino acids 56-70 of tyrosinase | **GVRIVVEYC**QNILLSNAPLGPQFP (SEQ ID NO: 373),<br>QNILLSNAPLGPQFP**GVRIVVEYC**QNILLSNAPLGPQFP (SEQ ID NO: 374) |
| | amino acids 448-462 of tyrosinase | **GVRIVVEYC**DYSYL QDSDPDSFQD (SEQ ID NO: 375),<br>DYSYLQDSDPDSFQD**GVRIVVEYC**DYSYLQDSDPDSFQD (SEQ ID NO: 376) |
| | amino acids 32-40 of Melan-A$^{MART-1}$ | **GVRIVVEYC**JLTVILGVL (SEQ ID NO: 377),<br>JLTVILGVL**GVRIVVEYC**JLTVILGVL (SEQ ID NO: 378) |

TABLE B-continued

| C35 Peptide/Epitope | Exemplary Tumor Rejection Peptide | Exemplary Polytopes |
|---|---|---|
| | amino acids 154-162 of gp100$^{Pmel17}$ | **GVRIVVEYC**KTWGQYWQV (SEQ ID NO: 379),<br>KTWGQYWQV**GVRIVVEYC**KTWGQYWQV (SEQ ID NO: 380) |
| | amino acids 209-217 of gp100$^{Pmel17}$ | **GVRIVVEYC**ITDQVPFSV (SEQ ID NO: 381),<br>ITDQVPFSV**GVRIVVEYC**ITDQVPFSV (SEQ ID NO: 382) |
| | amino acids 280-288 of gp100$^{Pmel17}$ | **GVRIVVEYC**YLEPGPVTA (SEQ ID NO: 383),<br>YLEPGPVTA**GVRIVVEYC**YLEPGPVTA (SEQ ID NO: 384) |
| | amino acids 457-466 of gp100$^{Pmel17}$ | **GVRIVVEYC**LLDGTATLRL (SEQ ID NO: 385),<br>LLDGTATLRL**GVRIVVEYC**LLDGTATLRL (SEQ ID NO: 386) |
| | amino acids 476-485 of gp100$^{Pmel17}$ | **GVRIVVEYC**VLYRYGSFSV (SEQ ID NO: 387),<br>VLYRYGSFSV**GVRIVVEYC**VLYRYGSFSV (SEQ ID NO: 388) |
| | amino acids 301-309 of PRAME | **GVRIVVEYC**LYVDSLFFL (SEQ ID NO: 389),<br>LYVDSLFFL**GVRIVVEYC**LYVDSLFFL (SEQ ID NO: 390) |
| | amino acids 292-303 of MAGE-6 | **GVRIVVEYC**KISGGPRISYPL (SEQ ID NO: 391),<br>KISGGPRISYPL**GVRIVVEYC**KISGGPRISYPL (SEQ ID NO: 392) |
| | amino acids 157-167 of NY-ESO-1 | **GVRIVVEYC**SLLMWITQCFL (SEQ ID NO: 393),<br>SLLMWITQCFL**GVRIVVEYC**SLLMWITQCFL (SEQ ID NO: 394) |
| | amino acids 157-165 of NY-ESO-1 | **GVRIVVEYC**SLLMWITQC (SEQ ID NO: 395),<br>SLLMWITQC**GVRIVVEYC**SLLMWITQC (SEQ ID NO: 396) |
| | amino acids 155-163 of NY-ESO-1 | **GVRIVVEYC**QLSLLMWIT (SEQ ID NO: 397),<br>QLSLLMWIT**GVRIVVEYC**QLSLLMWIT (SEQ ID NO: 398) |
| | amino acids 157-170 of NY-ESO-1 and<br>amino acids 281-295 of MAGE-3 | SLLMWITQCFLPVF **GVRIVVEYC**TSYVKVLHHMVKISG (SEQ ID NO: 399) |
| I25 to C33 of SEQ ID NO: 2<br>IVVEYCEPC | amino acids 161-169 of MAGE-1 | **IVVEYCEPC**EADPTGHSY (SEQ ID NO: 400),<br>EADPTGHSY**IVVEYCEPC**EADPTGHSY (SEQ ID NO: 401) |
| | amino acids 230-238 of MAGE-1 | **IVVEYCEPC**SAYGEPRKL (SEQ ID NO: 402),<br>SAYGEPRKL**IVVEYCEPC**SAYGEPRKL (SEQ ID NO: 403) |
| | amino acids 168-176 of MAGE-3 | **IVVEYCEPC**EVDPIGHLY (SEQ ID NO: 404),<br>EVDPIGHLY**IVVEYCEPC**EVDPIGHLY (SEQ ID NO: 405) |
| | amino acids 271-279 of MAGE-3 | **IVVEYCEPC**FLWGPRALV (SEQ ID NO: 406),<br>FLWGPRALV**IVVEYCEPC**FLWGPRALV (SEQ ID NO: 407) |
| | amino acids 167-176 of MAGE-3 | **IVVEYCEPC** MEVDPIGHLY (SEQ ID NO: 408),<br>MEVDPIGHLY**IVVEYCEPC**MEVDPIGHLY (SEQ ID NO: 409) |
| | amino acids 2-10 of BAGE | **IVVEYCEPC**AARAVFLAL (SEQ ID NO: 410),<br>AARAVFLAL**IVVEYCEPC**AARAVFLAL (SEQ ID NO: 411) |

TABLE B-continued

| C35 Peptide/Epitope | Exemplary Tumor Rejection Peptide | Exemplary Polytopes |
|---|---|---|
| | amino acids 9-16 of GAGE-1,2 | **IVVEYCEPC**YRPRPRRY (SEQ ID NO: 412), YRPRPRRY**IVVEYCEPC**YRPRPRRY (SEQ ID NO: 413) |
| | amino acids 11-20 of RAGE | **IVVEYCEPC**SPSSNRIRNT (SEQ ID NO: 414), SPSSNRIRNT**IVVEYCEPC**SPSSNRIRNT (SEQ ID NO: 415) |
| | amino acids 23-32 of CDK4 | **IVVEYCEPC**ACDPHSGHFV (SEQ ID NO: 416), ACDPHSGHFV**IVVEYCEPC**ACDPHSGHFV (SEQ ID NO: 417) |
| | amino acids 29-37 of β-catenin | **IVVEYCEPC**SYLDSGIHF (SEQ ID NO: 418), SYLDSGIHF**IVVEYCEPC**SYLDSGIHF (SEQ ID NO: 419) |
| | amino acids 1-9 of tyrosinase | **IVVEYCEPC** MLLAVLYCL (SEQ ID NO: 420), MLLAVLYCL**IVVEYCEPC**MLLAVLYCL (SEQ ID NO: 421) |
| | amino acids 206-214 of tyrosinase | **IVVEYCEPC** AFLPWHRLF (SEQ ID NO: 422), AFLPWHRLF**IVVEYCEPC**AFLPWHRLF (SEQ ID NO: 423) |
| | amino acids 56-70 of tyrosinase | **IVVEYCEPC**QNILLSNAPLGPQFP (SEQ ID NO: 424), QNILLSNAPLGPQFP**IVVEYCEPC**QNILLSNAPLGPQFP (SEQ ID NO: 425) |
| | amino acids 448-462 of tyrosinase | **IVVEYCEPC**DYSYLQDSDPDSFQD (SEQ ID NO: 426), DYSYLQDSDPDSFQD**IVVEYCEPC**DYSYLQDSDPDSFQD (SEQ ID NO: 427) |
| | amino acids 32-40 of Melan-A$^{MART-1}$ | **IVVEYCEPC**JLTVILGVL (SEQ ID NO: 428), JLTVILGVL**IVVEYCEPC**JLTVILGVL (SEQ ID NO: 429) |
| | amino acids 154-162 of gp100$^{Pmel17}$ | **IVVEYCEPC**KTWGQYWQV (SEQ ID NO: 430), KTWGQYWQV**IVVEYCEPC**KTWGQYWQV (SEQ ID NO: 431) |
| | amino acids 209-217 of gp100$^{Pmel17}$ | **IVVEYCEPC**ITDQVPFSV (SEQ ID NO: 432), ITDQVPFSV**IVVEYCEPC**ITDQVPFSV (SEQ ID NO: 433) |
| | amino acids 280-288 of gp100$^{Pmel17}$ | **IVVEYCEPC**YLEPGPVTA (SEQ ID NO: 434), YLEPGPVTA**IVVEYCEPC**YLEPGPVTA (SEQ ID NO: 435) |
| | amino acids 457-466 of gp100$^{Pmel17}$ | **IVVEYCEPC**LLDGTATLRL (SEQ ID NO: 436), LLDGTATLRL**IVVEYCEPC**LLDGTATLRL (SEQ ID NO: 437) |
| | amino acids 476-485 of gp100$^{Pmel17}$ | **IVVEYCEPC**VLYRYGSFSV (SEQ ID NO: 438), VLYRYGSFSV**IVVEYCEPC**VLYRYGSFSV (SEQ ID NO: 439) |
| | amino acids 301-309 of PRAME | **IVVEYCEPC**LYVDSLFFL (SEQ ID NO: 440), LYVDSLFFL**IVVEYCEPC**LYVDSLFFL (SEQ ID NO: 441) |
| | amino acids 292-303 of MAGE-6 | **IVVEYCEPC**KISGGPRISYPL (SEQ ID NO: 442), KISGGPRISYPL**IVVEYCEPC**KISGGPRISYPL (SEQ ID NO: 443) |
| | amino acids 157-167 of NY-ESO-1 | **IVVEYCEPC**SLLMWITQCFL (SEQ ID NO: 444), SLLMWITQCFL**IVVEYCEPC**SLLMWITQCFL (SEQ ID NO: 445) |

TABLE B-continued

| C35 Peptide/Epitope | Exemplary Tumor Rejection Peptide | Exemplary Polytopes |
|---|---|---|
| | amino acids 157-165 of NY-ESO-1 | **IVVEYCEPC**SLLMWITQC (SEQ ID NO: 446),<br>SLLMWITQC**IVVEYCEPC**SLLMWITQC (SEQ ID NO: 447) |
| | amino acids 155-163 of NY-ESO-1 | **IVVEYCEPC**QLSLLMWIT (SEQ ID NO: 448),<br>QLSLLMWIT**IVVEYCEPC**VQLSLLMWIT (SEQ ID NO: 449) |
| | amino acids 157-170 of NY-ESO-1 and amino acids 281-295 of MAGE-3 | SLLMWITQCFLPVF**IVVEYCEPC**TSYVKVLHHMVKISG (SEQ ID NO: 450) |
| T38-V46 of SEQ ID NO: 2 TYLELASAV | amino acids 161-169 of MAGE-1 | **TYLELASAV**EADPTGHSY (SEQ ID NO: 451),<br>EADPTGHSY**TYLELASAV**EADPTGHSY (SEQ ID NO: 452) |
| | amino acids 230-238 of MAGE-1 | **TYLELASAV**SAYGEPRKL (SEQ ID NO: 453),<br>SAYGEPRKL**TYLELASAV**SAYGEPRKL (SEQ ID NO: 454) |
| | amino acids 168-176 of MAGE-3 | **TYLELASAV**EVDPIGHLY (SEQ ID NO: 455),<br>EVDPIGHLY**TYLELASAV**EVDPIGHLY (SEQ ID NO: 456) |
| | amino acids 271-279 of MAGE-3 | **TYLELASAV**FLWGPRALV (SEQ ID NO: 457),<br>FLWGPRALV**TYLELASAV**FLWGPRALV (SEQ ID NO: 458) |
| | amino acids 167-176 of MAGE-3 | **TYLELASAV**MEVDPIGHLY (SEQ ID NO: 459),<br>MEVDPIGHLY**TYLELASAV**MEVDPIGHLY (SEQ ID NO: 460) |
| | amino acids 2-10 of BAGE | **TYLELASAV**AARAVFLAL (SEQ ID NO: 461),<br>AARAVFLAL**TYLELASAV**AARAVFLAL (SEQ ID NO: 462) |
| | amino acids 9-16 of GAGE-1,2 | **TYLELASAV**YRPRPRRY (SEQ ID NO: 463),<br>YRPRPRRY**TYLELASAV**YRPRPRRY (SEQ ID NO: 464) |
| | amino acids 11-20 of RAGE | **TYLELASAV**SPSSNRIRNT (SEQ ID NO: 465),<br>SPSSNRIRNT**TYLELASAV**SPSSNRIRNT (SEQ ID NO: 466) |
| | amino acids 23-32 of CDK4 | **TYLELASAV**ACDPHSGHFV (SEQ ID NO: 467),<br>ACDPHSGHFV**TYLELASAV**ACDPHSGHFV (SEQ ID NO: 468) |
| | amino acids 29-37 of β-catenin | **TYLELASAV**SYLDSGIHF (SEQ ID NO: 469),<br>SYLDSGIHF**TYLELASAV**SYLDSGIHF (SEQ ID NO: 470) |
| | amino acids 1-9 of tyrosinase | **TYLELASAV**MLLAVLYCL (SEQ ID NO: 471),<br>MLLAVLYCL**TYLELASAV**MLLAVLYCL (SEQ ID NO: 472) |
| | amino acids 206-214 of tyrosinase | **TYLELASAV**AFLPWHRLF (SEQ ID NO: 473),<br>AFLPWHRLF**TYLELASAV**AFLPWHRLF (SEQ ID NO: 474) |
| | amino acids 56-70 of tyrosinase | **TYLELASAV**QNILLSNAPLGPQFP (SEQ ID NO: 475),<br>QNILLSNAPLGPQFP**TYLELASAV**QNILLSNAPLGPQFP (SEQ ID NO: 476) |
| | amino acids 448-462 of tyrosinase | **TYLELASAV**DYSYLQDSDPDSFQD (SEQ ID NO: 477),<br>DYSYLQDSDPDSFQD**TYLELASAV**DYSYLQDSDPDSFQD (SEQ ID NO: 478) |

TABLE B-continued

| C35 Peptide/Epitope | Exemplary Tumor Rejection Peptide | Exemplary Polytopes |
|---|---|---|
| | amino acids 32-40 of Melan-A$^{MART-1}$ | **TYLELASAV**JLTVILGVL (SEQ ID NO: 479),<br>JLTVILGVL**TYLELASAV**JLTVILGVL (SEQ ID NO: 480) |
| | amino acids 154-162 of gp100$^{Pmel17}$ | **TYLELASAV**KTWGQYWQV (SEQ ID NO: 481),<br>KTWGQYWQV**TYLELASAV**KTWGQYWQV (SEQ ID NO: 482) |
| | amino acids 209-217 of gp100$^{Pmel17}$ | **TYLELASAV**ITDQVPFSV (SEQ ID NO: 483),<br>ITDQVPFSV**TYLELASAV**ITDQVPFSV (SEQ ID NO: 484) |
| | amino acids 280-288 of gp100$^{Pmel17}$ | **TYLELASAV**YLEPGPVTA (SEQ ID NO: 485),<br>YLEPGPVTA**TYLELASAV**YLEPGPVTA (SEQ ID NO: 486) |
| | amino acids 457-466 of gp100$^{Pmel17}$ | **TYLELASAV**LLDGTATLRL (SEQ ID NO: 487),<br>LLDGTATLRL**TYLELASAV**LLDGTATLRL (SEQ ID NO: 488) |
| | amino acids 476-485 of gp100$^{Pmel17}$ | **TYLELASAV**VLYRYGSFSV (SEQ ID NO: 489),<br>VLYRYGSFSV**TYLELASAV**VLYRYGSFSV (SEQ ID NO: 490) |
| | amino acids 301-309 of PRAME | **TYLELASAV**LYVDSLFFL (SEQ ID NO: 491),<br>LYVDSLFFL**TYLELASAV**LYVDSLFFL (SEQ ID NO: 492) |
| | amino acids 292-303 of MAGE-6 | **TYLELASAV**KISGGPRISYPL (SEQ ID NO: 493),<br>KISGGPRISYPL**TYLELASAV**KISGGPRISYPL (SEQ ID NO: 494) |
| | amino acids 157-167 of NY-ESO-1 | **TYLELASAV**SLLMWITQCFL (SEQ ID NO: 495),<br>SLLMWITQCFL**TYLELASAV**SLLMWITQCFL (SEQ ID NO: 496) |
| | amino acids 157-165 of NY-ESO-1 | **TYLELASAV**SLLMWITQC (SEQ ID NO: 497),<br>SLLMWITQC**TYLELASAV**SLLMWITQC (SEQ ID NO: 498) |
| | amino acids 155-163 of NY-ESO-1 | **TYLELASAV**QLSLLMWIT (SEQ ID NO: 499),<br>QLSLLMWIT**TYLELASAV**QLSLLMWIT (SEQ ID NO: 500) |
| | amino acids 157-170 of NY-ESO-1 and<br>amino acids 281-295 of MAGE-3 | SLLMWITQCFLPVF **TYLELASAV**TSYVKVLHHMVKISG (SEQ ID NO: 501) |
| G61-I69 of SEQ ID NO: 2<br>GTGAFEIEI | amino acids 161-169 of MAGE-1 | **GTGAFEIEI**EADPTGHSY (SEQ ID NO: 502),<br>EADPTGHSY**GTGAFEIEI**EADPTGHSY (SEQ ID NO: 503) |
| | amino acids 230-238 of MAGE-1 | **GTGAFEIEI**SAYGEPRKL (SEQ ID NO: 504),<br>SAYGEPRKL**GTGAFEIEI**SAYGEPRKL (SEQ ID NO: 505) |
| | amino acids 168-176 of MAGE-3 | **GTGAFEIEI**EVDPIGHLY (SEQ ID NO: 506),<br>EVDPIGHLY**GTGAFEIEI**EVDPIGHLY (SEQ ID NO: 507) |
| | amino acids 271-279 of MAGE-3 | **GTGAFEIEI**FLWGPRALV (SEQ ID NO: 508),<br>FLWGPRALV**GTGAFEIEI**FLWGPRALV (SEQ ID NO: 509) |
| | amino acids 167-176 of MAGE-3 | **GTGAFEIEI**MEVDPIGHLY (SEQ ID NO: 510),<br>MEVDPIGHLY**GTGAFEIEI**MEVDPIGHLY (SEQ ID NO: 511) |

TABLE B-continued

| C35 Peptide/Epitope | Exemplary Tumor Rejection Peptide | Exemplary Polytopes |
|---|---|---|
| | amino acids 2-10 of BAGE | **GTGAFEIEI**AARAVFLAL (SEQ ID NO: 512),<br>AARAVFLAL**GTGAFEIEI**AARAVFLAL (SEQ ID NO: 513) |
| | amino acids 9-16 of GAGE-1,2 | **GTGAFEIEI**YRPRPRRY (SEQ ID NO: 514),<br>YRPRPRRY**GTGAFEIEI**YRPRPRRY (SEQ ID NO: 515) |
| | amino acids 11-20 of RAGE | **GTGAFEIEI**SPSSNRIRNT (SEQ ID NO: 516),<br>SPSSNRIRNT**GTGAFEIEI**SPSSNRIRNT (SEQ ID NO: 517) |
| | amino acids 23-32 of CDK4 | **GTGAFEIEI**ACDPHSGHFV (SEQ ID NO: 518),<br>ACDPHSGHFV**GTGAFEIEI**ACDPHSGHFV (SEQ ID NO: 519) |
| | amino acids 29-37 of β-catenin | **GTGAFEIEI**SYLDSGIHF (SEQ ID NO: 520),<br>SYLDSGIHF**GTGAFEIEI**SYLDSGIHF (SEQ ID NO: 521) |
| | amino acids 1-9 of tyrosinase | **GTGAFEIEI**MLLAVLYCL (SEQ ID NO: 522),<br>MLLAVLYCL**GTGAFEIEI**MLLAVLYCL (SEQ ID NO: 523) |
| | amino acids 206-214 of tyrosinase | **GTGAFEIEI**AFLPWHRLF (SEQ ID NO: 524),<br>AFLPWHRLF**GTGAFEIEI**AFLPWHRLF (SEQ ID NO: 525) |
| | amino acids 56-70 of tyrosinase | **GTGAFEIEI**QNILLSNAPLGPQFP (SEQ ID NO: 526),<br>QNILLSNAPLGPQFP**GTGAFEIEI**QNILLSNAPLGPQFP (SEQ ID NO: 527) |
| | amino acids 448-462 of tyrosinase | **GTGAFEIEI**DYSYLQDSDPDSFQD (SEQ ID NO: 528),<br>DYSYLQDSDPDSFQD**GTGAFEIEI**DYSYLQDSDPDSFQD (SEQ ID NO: 529) |
| | amino acids 32-40 of Melan-A$^{MART-1}$ | **GTGAFEIEI**JLTVILGVL (SEQ ID NO: 530),<br>JLTVILGVL**GTGAFEIEI**JLTVILGVL (SEQ ID NO: 531) |
| | amino acids 154-162 of gp100$^{Pmel17}$ | **GTGAFEIEI**KTWGQYWQV (SEQ ID NO: 532),<br>KTWGQYWQV**GTGAFEIEI**KTWGQYWQV (SEQ ID NO: 533) |
| | amino acids 209-217 of gp100$^{Pmel17}$ | **GTGAFEIEI**ITDQVPFSV (SEQ ID NO: 534),<br>ITDQVPFSV**GTGAFEIEI**ITDQVPFSV (SEQ ID NO: 535) |
| | amino acids 280-288 of gp100$^{Pmel17}$ | **GTGAFEIEI**YLEPGPVTA (SEQ ID NO: 536),<br>YLEPGPVTA**GTGAFEIEI**YLEPGPVTA (SEQ ID NO: 537) |
| | amino acids 457-466 of gp100$^{Pmel17}$ | **GTGAFEIEI**LLDGTATLRL (SEQ ID NO: 538),<br>LLDGTATLRL**GTGAFEIEI**LLDGTATLRL (SEQ ID NO: 539) |
| | amino acids 476-485 of gp100$^{Pmel17}$ | **GTGAFEIEI**VLYRYGSFSV (SEQ ID NO: 540),<br>VLYRYGSFSV**GTGAFEIEI**VLYRYGSFSV (SEQ ID NO: 541) |
| | amino acids 301-309 of PRAME | **GTGAFEIEI**LYVDSLFFL (SEQ ID NO: 542),<br>LYVDSLFFL**GTGAFEIEI**LYVDSLFFL (SEQ ID NO: 543) |
| | amino acids 292-303 of MAGE-6 | **GTGAFEIEI**KISGGPRISYPL (SEQ ID NO: 544),<br>KISGGPRISYPL**GTGAFEIEI**KISGGPRISYPL (SEQ ID NO: 545) |

TABLE B-continued

| C35 Peptide/Epitope | Exemplary Tumor Rejection Peptide | Exemplary Polytopes |
|---|---|---|
| | amino acids 157-167 of NY-ESO-1 | **GTGAFEIEI**SLLMWITQCFL (SEQ ID NO: 546),<br>SLLMWITQCFL**GTGAFEIEI**SLLMWITQCFL (SEQ ID NO: 547) |
| | amino acids 157-165 of NY-ESO-1 | **GTGAFEIEI**SLLMWITQC (SEQ ID NO: 548),<br>SLLMWITQC**GTGAFEIEI**SLLMWITQC (SEQ ID NO: 549) |
| | amino acids 155-163 of NY-ESO-1 | **GTGAFEIEI**QLSLLMWIT (SEQ ID NO: 550),<br>QLSLLMWIT**GTGAFEIEI**QLSLLMWIT (SEQ ID NO: 551) |
| | amino acids 157-170 of NY-ESO-1 and amino acids 281-295 of MAGE-3 | SLLMWITQCFLPVF**GTGAFEIEI**TSYVKVLHHMVKISG (SEQ ID NO: 552) |
| F65-L73 of SEQ ID NO: 2<br>FEIEINGQL | amino acids 161-169 of MAGE-1 | **FEIEINGQL**EADPTGHSY (SEQ ID NO: 553),<br>EADPTGHSY**FEIEINGQL**EADPTGHSY (SEQ ID NO: 554) |
| | amino acids 230-238 of MAGE-1 | **FEIEINGQL**SAYGEPRKL (SEQ ID NO: 555),<br>SAYGEPRKL**FEIEINGQL**SAYGEPRKL (SEQ ID NO: 556) |
| | amino acids 168-176 of MAGE-3 | **FEIEINGQL**EVDPIGHLY (SEQ ID NO: 557),<br>EVDPIGHLY**FEIEINGQL**EVDPIGHLY (SEQ ID NO: 558) |
| | amino acids 271-279 of MAGE-3 | **FEIEINGQL**FLWGPRALV (SEQ ID NO: 559),<br>FLWGPRALV**FEIEINGQL**FLWGPRALV (SEQ ID NO: 560) |
| | amino acids 167-176 of MAGE-3 | **FEIEINGQL**MEVDPIGHLY (SEQ ID NO: 561),<br>MEVDPIGHLY**FEIEINGQL**MEVDPIGHLY (SEQ ID NO: 562) |
| | amino acids 2-10 of BAGE | **FEIEINGQL**AARAVFLAL (SEQ ID NO: 563),<br>AARAVFLAL**FEIEINGQL**AARAVFLAL (SEQ ID NO: 564) |
| | amino acids 9-16 of GAGE-1,2 | **FEIEINGQL**YRPRPRRY (SEQ ID NO: 565),<br>YRPRPRRY**FEIEINGQL**YRPRPRRY (SEQ ID NO: 566) |
| | amino acids 11-20 of RAGE | **FEIEINGQL**SPSSNRIRNT (SEQ ID NO: 567),<br>SPSSNRIRNT**FEIEINGQL**SPSSNRIRNT (SEQ ID NO: 568) |
| | amino acids 23-32 of CDK4 | **FEIEINGQL**ACDPHSGHFV (SEQ ID NO: 569),<br>ACDPHSGHFV**FEIEINGQL**ACDPHSGHFV (SEQ ID NO: 570) |
| | amino acids 29-37 of β-catenin | **FEIEINGQL**SYLDSGIHF (SEQ ID NO: 571),<br>SYLDSGIHF**FEIEINGQL**SYLDSGIHF (SEQ ID NO: 572) |
| | amino acids 1-9 of tyrosinase | **FEIEINGQL**MLLAVLYCL (SEQ ID NO: 573),<br>MLLAVLYCL**FEIEINGQL**MLLAVLYCL (SEQ ID NO: 574) |
| | amino acids 206-214 of tyrosinase | **FEIEINGQL** AFLPWHRLF (SEQ ID NO: 575),<br>AFLPWHRLF**FEIEINGQL**AFLPWHRLF (SEQ ID NO: 576) |
| | amino acids 56-70 of tyrosinase | **FEIEINGQL**QNILLSNAPLGPQFP (SEQ ID NO: 577),<br>QNILLSNAPLGPQFP**FEIEINGQL**QNILLSNAPLGPQFP (SEQ ID NO: 578) |

TABLE B-continued

| C35 Peptide/Epitope | Exemplary Tumor Rejection Peptide | Exemplary Polytopes |
|---|---|---|
| | amino acids 448-462 of tyrosinase | **FEIEINGQL**DYSYLQDSDPDSFQD (SEQ ID NO: 579),<br>DYSYLQDSDPDSFQD**FEIEINGQL**DYSYLQDSDPDSFQD (SEQ ID NO: 580) |
| | amino acids 32-40 of Melan-A$^{MART-1}$ | **FEIEINGQL**JLTVILGVL (SEQ ID NO: 581),<br>JLTVILGVL**FEIEINGQL**JLTVILGVL (SEQ ID NO: 582) |
| | amino acids 154-162 of gp100$^{Pmel17}$ | **FEIEINGQL**KTWGQYWQV (SEQ ID NO: 583),<br>KTWGQYWQV**FEIEINGQL**KTWGQYWQV (SEQ ID NO: 584) |
| | amino acids 209-217 of gp100$^{Pmel17}$ | **FEIEINGQL**ITDQVPFSV (SEQ ID NO: 585),<br>ITDQVPFSV**FEIEINGQL**ITDQVPFSV (SEQ ID NO: 586) |
| | amino acids 280-288 of gp100$^{Pmel17}$ | **FEIEINGQL**YLEPGPVTA (SEQ ID NO: 587),<br>YLEPGPVTA**FEIEINGQL**YLEPGPVTA (SEQ ID NO: 588) |
| | amino acids 457-466 of gp100$^{Pmel17}$ | **FEIEINGQL**LLDGTATLRL (SEQ ID NO: 589),<br>LLDGTATLRL**FEIEINGQL**LLDGTATLRL (SEQ ID NO: 590) |
| | amino acids 476-485 of gp100$^{Pmel17}$ | **FEIEINGQL**VLYRYGSFSV (SEQ ID NO: 591),<br>VLYRYGSFSV**FEIEINGQL**VLYRYGSFSV (SEQ ID NO: 592) |
| | amino acids 301-309 of PRAME | **FEIEINGQL**LYVDSLFFL (SEQ ID NO: 593),<br>LYVDSLFFL**FEIEINGQL**LYVDSLFFL (SEQ ID NO: 594) |
| | amino acids 292-303 of MAGE-6 | **FEIEINGQL**KISGGPRISYPL (SEQ ID NO: 595),<br>KISGGPRISYPL**FEIEINGQL**KISGGPRISYPL (SEQ ID NO: 596) |
| | amino acids 157-167 of NY-ESO-1 | **FEIEINGQL**SLLMWITQCFL (SEQ ID NO: 597),<br>SLLMWITQCFL**FEIEINGQL**SLLMWITQCFL (SEQ ID NO: 598) |
| | amino acids 157-165 of NY-ESO-1 | **FEIEINGQL**SLLMWITQC (SEQ ID NO: 599),<br>SLLMWITQC**FEIEINGQL**SLLMWITQC (SEQ ID NO: 600) |
| | amino acids 155-163 of NY-ESO-1 | **FEIEINGQL**QLSLLMWIT (SEQ ID NO: 601),<br>QLSLLMWIT**FEIEINGQL**QLSLLMWIT (SEQ ID NO: 602) |
| | amino acids 157-170 of NY-ESO-1 and amino acids 281-295 of MAGE-3 | SLLMWITQCFLPVF**FEIEINGQL**TSYVKVLHHMVKISG (SEQ ID NO: 603) |
| I67-F75 of SEQ ID NO: 2<br>IEINGQLVF | amino acids 161-169 of MAGE-1 | **IEINGQLVF**EADPTGHSY (SEQ ID NO: 604),<br>EADPTGHSY**IEINGQLVF**EADPTGHSY (SEQ ID NO: 605) |
| | amino acids 230-238 of MAGE-1 | **IEINGQLVF**SAYGEPRKL (SEQ ID NO: 606),<br>SAYGEPRKL**IEINGQLVF**SAYGEPRKL (SEQ ID NO: 607) |
| | amino acids 168-176 of MAGE-3 | **IEINGQLVF**EVDPIGHLY (SEQ ID NO: 608),<br>EVDPIGHLY**IEINGQLVF**EVDPIGHLY (SEQ ID NO: 609) |
| | amino acids 271-279 of MAGE-3 | **IEINGQLVF**FLWGPRALV (SEQ ID NO: 610),<br>FLWGPRALV**IEINGQLVF**FLWGPRALV (SEQ ID NO: 611) |

TABLE B-continued

| C35 Peptide/Epitope | Exemplary Tumor Rejection Peptide | Exemplary Polytopes |
|---|---|---|
| | amino acids 167-176 of MAGE-3 | **IEINGQLVF**MEVDPIGHLY (SEQ ID NO: 612),<br>MEVDPIGHLY**IEINGQLVF**MEVDPIGHLY (SEQ ID NO: 613) |
| | amino acids 2-10 of BAGE | **IEINGQLVF**AARAVFLAL (SEQ ID NO: 614),<br>AARAVFLAL**IEINGQLVF**AARAVFLAL (SEQ ID NO: 615) |
| | amino acids 9-16 of GAGE-1,2 | **IEINGQLVF**YRPRPRRY (SEQ ID NO: 616),<br>YRPRPRRY**IEINGQLVF**YRPRPRRY (SEQ ID NO: 617) |
| | amino acids 11-20 of RAGE | **IEINGQLVF**SPSSNRIRNT (SEQ ID NO: 618),<br>SPSSNRIRNT**IEINGQLVF**SPSSNRIRNT (SEQ ID NO: 619) |
| | amino acids 23-32 of CDK4 | **IEINGQLVF**CDPHSGHFV (SEQ ID NO: 620),<br>ACDPHSGHFV**IEINGQLVF**ACDPHSGHFV (SEQ ID NO: 621) |
| | amino acids 29-37 of β-catenin | **IEINGQLVF**SYLDSGIHF (SEQ ID NO: 622),<br>SYLDSGIHF**IEINGQLVF**SYLDSGIHF (SEQ ID NO: 623) |
| | amino acids 1-9 of tyrosinase | **IEINGQLVF**MLLAVLYCL (SEQ ID NO: 624),<br>MLLAVLYCL**IEINGQLVF**MLLAVLYCL (SEQ ID NO: 625) |
| | amino acids 206-214 of tyrosinase | **IEINGQLVF** AFLPWHRLF (SEQ ID NO: 626),<br>AFLPWHRLF**IEINGQLVF**AFLPWHRLF (SEQ ID NO: 627) |
| | amino acids 56-70 of tyrosinase | **IEINGQLVF**QNILLSNAPLGPQFP (SEQ ID NO: 628),<br>QNILLSNAPLGPQFP**IEINGQLVF**QNILLSNAPLGPQFP (SEQ ID NO: 629) |
| | amino acids 448-462 of tyrosinase | **IEINGQLVF**DYSYLQDSDPDSFQD (SEQ ID NO: 630),<br>DYSYLQDSDPDSFQD**IEINGQLVF**DYSYLQDSDPDSFQD (SEQ ID NO: 631) |
| | amino acids 32-40 of Melan-$A^{MART-1}$ | **IEINGQLVF**JLTVILGVL (SEQ ID NO: 632),<br>JLTVILGVL**IEINGQLVF**JLTVILGVL (SEQ ID NO: 633) |
| | amino acids 154-162 of $gp100^{Pmel17}$ | **IEINGQLVF**KTWGQYWQV (SEQ ID NO: 634),<br>KTWGQYWQV**IEINGQLVF**KTWGQYWQV (SEQ ID NO: 635) |
| | amino acids 209-217 of $gp100^{Pmel17}$ | **IEINGQLVF**ITDQVPFSV (SEQ ID NO: 636),<br>ITDQVPFSV**IEINGQLVF**ITDQVPFSV (SEQ ID NO: 637) |
| | amino acids 280-288 of $gp100^{Pmel17}$ | **IEINGQLVF**YLEPGPVTA (SEQ ID NO: 638),<br>YLEPGPVTA**IEINGQLVF**YLEPGPVTA (SEQ ID NO: 639) |
| | amino acids 457-466 of $gp100^{Pmel17}$ | **IEINGQLVF**LLDGTATLRL (SEQ ID NO: 640),<br>LLDGTATLRL**IEINGQLVF**LLDGTATLRL (SEQ ID NO: 641) |
| | amino acids 476-485 of $gp100^{Pmel17}$ | **IEINGQLVF**VLYRYGSFSV (SEQ ID NO: 642),<br>VLYRYGSFSV**IEINGQLVF**VLYRYGSFSV (SEQ ID NO: 643) |
| | amino acids 301-309 of PRAME | **IEINGQLVF**LYVDSLFFL (SEQ ID NO: 644),<br>LYVDSLFFL**IEINGQLVF**LYVDSLFFL (SEQ ID NO: 645) |

TABLE B-continued

| C35 Peptide/Epitope | Exemplary Tumor Rejection Peptide | Exemplary Polytopes |
|---|---|---|
| | amino acids 292-303 of MAGE-6 | **IEINGQLVF**KISGGPRISYPL (SEQ ID NO: 646),<br>KISGGPRISYPL**IEINGQLVF**KISGGPRISYPL (SEQ ID NO: 647) |
| | amino acids 157-167 of NY-ESO-1 | **IEINGQLVF**SLLMWITQCFL (SEQ ID NO: 648),<br>SLLMWITQCFL**IEINGQLVF**SLLMWITQCFL (SEQ ID NO: 649) |
| | amino acids 157-165 of NY-ESO-1 | **IEINGQLVF**SLLMWITQC (SEQ ID NO: 650),<br>SLLMWITQC**IEINGQLVF**SLLMWITQC (SEQ ID NO: 651) |
| | amino acids 155-163 of NY-ESO-1 | **IEINGQLVF**QLSLLMWIT (SEQ ID NO: 652),<br>QLSLLMWIT**IEINGQLVF**QLSLLMWIT (SEQ ID NO: 653) |
| | amino acids 157-170 of NY-ESO-1 and amino acids 281-295 of MAGE-3 | SLLMWITQCFLPVF**IEINGQLVF**TSYVKVLHHMVKISG (SEQ ID NO: 654) |
| K77-Y85 of SEQ ID NO: 2<br>KLENGGFPY | amino acids 161-169 of MAGE-1 | **KLENGGFPY**EADPTGHSY (SEQ ID NO: 655),<br>EADPTGHSY**KLENGGFPY**EADPTGHSY (SEQ ID NO: 656) |
| | amino acids 230-238 of MAGE-1 | **KLENGGFPY**SAYGEPRKL (SEQ ID NO: 657),<br>SAYGEPRKL**KLENGGFPY**SAYGEPRKL (SEQ ID NO: 658) |
| | amino acids 168-176 of MAGE-3 | **KLENGGFPY**EVDPIGHLY (SEQ ID NO: 659),<br>EVDPIGHLY**KLENGGFPY**EVDPIGHLY (SEQ ID NO: 660) |
| | amino acids 271-279 of MAGE-3 | **KLENGGFPY**FLWGPRALV (SEQ ID NO: 661),<br>FLWGPRALV**KLENGGFPY**FLWGPRALV (SEQ ID NO: 662) |
| | amino acids 167-176 of MAGE-3 | **KLENGGFPY**MEVDPIGHLY (SEQ ID NO: 663),<br>MEVDPIGHLY**KLENGGFPY**MEVDPIGHLY (SEQ ID NO: 664) |
| | amino acids 2-10 of BAGE | **KLENGGFPY**AARAVFLAL (SEQ ID NO: 665),<br>AARAVFLAL**KLENGGFPY**AARAVFLAL (SEQ ID NO: 666) |
| | amino acids 9-16 of GAGE-1,2 | **KLENGGFPY**YRPRPRRY (SEQ ID NO: 667),<br>YRPRPRRY**KLENGGFPY**YRPRPRRY (SEQ ID NO: 668) |
| | amino acids 11-20 of RAGE | **KLENGGFPY**SPSSNRIRNT (SEQ ID NO: 669),<br>SPSSNRIRNT**KLENGGFPY**SPSSNRIRNT (SEQ ID NO: 670) |
| | amino acids 23-32 of CDK4 | **KLENGGFPY**ACDPHSGHFV (SEQ ID NO: 671),<br>ACDPHSGHFV**KLENGGFPY**ACDPHSGHFV (SEQ ID NO: 672) |
| | amino acids 29-37 of β-catenin | **KLENGGFPY**SYLDSGIHF (SEQ ID NO: 673),<br>SYLDSGIHF**KLENGGFPY**SYLDSGIHF (SEQ ID NO: 674) |
| | amino acids 1-9 of tyrosinase | **KLENGGFPY**MLLAVLYCL (SEQ ID NO: 675),<br>MLLAVLYCL**KLENGGFPY**MLLAVLYCL (SEQ ID NO: 676) |
| | amino acids 206-214 of tyrosinase | **KLENGGFPY**AFLPWHRLF (SEQ ID NO: 677),<br>AFLPWHRLF**KLENGGFPY**AFLPWHRLF (SEQ ID NO: 678) |

TABLE B-continued

| C35 Peptide/Epitope | Exemplary Tumor Rejection Peptide | Exemplary Polytopes |
|---|---|---|
| | amino acids 56-70 of tyrosinase | **KLENGGFPY**QNILLSNAPLGPQFP (SEQ ID NO: 679),<br>QNILLSNAPLGPQFP**KLENGGFPY**QNILLSNAPLGPQFP (SEQ ID NO: 680) |
| | amino acids 448-462 of tyrosinase | **KLENGGFPY**DYSYLQDSDPDSFQD (SEQ ID NO: 681),<br>DYSYLQDSDPDSFQD**KLENGGFPY**DYSYLQDSDPDSFQD (SEQ ID NO: 682) |
| | amino acids 32-40 of Melan-$A^{MART-1}$ | **KLENGGFPY**JLTVILGVL (SEQ ID NO: 683),<br>JLTVILGVL**KLENGGFPY**JLTVILGVL (SEQ ID NO: 684) |
| | amino acids 154-162 of $gp100^{Pmel17}$ | **KLENGGFPY**KTWGQYWQV (SEQ ID NO: 685),<br>KTWGQYWQV**KLENGGFPY**KTWGQYWQV (SEQ ID NO: 686) |
| | amino acids 209-217 of $gp100^{Pmel17}$ | **KLENGGFPY**ITDQVPFSV (SEQ ID NO: 687),<br>ITDQVPFSV**KLENGGFPY**ITDQVPFSV (SEQ ID NO: 688) |
| | amino acids 280-288 of $gp100^{Pmel17}$ | **KLENGGFPY**YLEPGPVTA (SEQ ID NO: 689),<br>YLEPGPVTA**KLENGGFPY**YLEPGPVTA (SEQ ID NO: 690) |
| | amino acids 457-466 of $gp100^{Pmel17}$ | **KLENGGFPY**LLDGTATLRL (SEQ ID NO: 691),<br>LLDGTATLRL**KLENGGFPY**LLDGTATLRL (SEQ ID NO: 692) |
| | amino acids 476-485 of $gp100^{Pmel17}$ | **KLENGGFPY**VLYRYGSFSV (SEQ ID NO: 693),<br>VLYRYGSFSV**KLENGGFPY**VLYRYGSFSV (SEQ ID NO: 694) |
| | amino acids 301-309 of PRAME | **KLENGGFPY**LYVDSLFFL (SEQ ID NO: 695),<br>LYVDSLFFL**KLENGGFPY**LYVDSLFFL (SEQ ID NO: 696) |
| | amino acids 292-303 of MAGE-6 | **KLENGGFPY**KISGGPRISYPL (SEQ ID NO: 697),<br>KISGGPRISYPL**KLENGGFPY**KISGGPRISYPL (SEQ ID NO: 698) |
| | amino acids 157-167 of NY-ESO-1 | **KLENGGFPY**SLLMWITQCFL (SEQ ID NO: 699),<br>SLLMWITQCFL**KLENGGFPY**SLLMWITQCFL (SEQ ID NO: 700) |
| | amino acids 157-165 of NY-ESO-1 | **KLENGGFPY**SLLMWITQC (SEQ ID NO: 701),<br>SLLMWITQC**KLENGGFPY**SLLMWITQC (SEQ ID NO: 702) |
| | amino acids 155-163 of NY-ESO-1 | **KLENGGFPY**QLSLLMWIT (SEQ ID NO: 703),<br>QLSLLMWIT**KLENGGFPY**QLSLLMWIT (SEQ ID NO: 704) |
| | amino acids 157-170 of NY-ESO-1 and amino acids 281-295 of MAGE-3 | SLLMWITQCFLPVF **KLENGGFPY**TSYVKVLHHMVKISG (SEQ ID NO: 705) |
| Q72-E86 of SEQ ID NO: 2<br>QLVFSKLENGGFPYE | amino acids 161-169 of MAGE-1 | **QLVFSKLENGGFPYE**EADPTGHSY (SEQ ID NO: 706),<br>EADPTGHSY**QLVFSKLENGGFPYE**EADPTGHSY (SEQ ID NO: 707) |
| | amino acids 230-238 of MAGE-1 | **QLVFSKLENGGFPYE**SAYGEPRKL (SEQ ID NO: 708),<br>SAYGEPRKL**QLVFSKLENGGFPYE**SAYGEPRKL (SEQ ID NO: 709) |
| | amino acids 168-176 of MAGE-3 | **QLVFSKLENGGFPYE**EVDPIGHLY (SEQ ID NO: 710),<br>EVDPIGHLY**QLVFSKLENGGFPYE**EVDPIGHLY (SEQ ID NO: 711) |

TABLE B-continued

| C35 Peptide/Epitope | Exemplary Tumor Rejection Peptide | Exemplary Polytopes |
|---|---|---|
| | amino acids 271-279 of MAGE-3 | **QLVFSKLENGGFPYE**FLWGPRALV (SEQ ID NO: 712),<br>FLWGPRALV**QLVFSKLENGGFPYE**FLWGPRALV (SEQ ID NO: 713) |
| | amino acids 167-176 of MAGE-3 | **QLVFSKLENGGFPYE**MEVDPIGHLY (SEQ ID NO: 714),<br>MEVDPIGHLY**QLVFSKLENGGFPYE**MEVDPIGHLY (SEQ ID NO: 715) |
| | amino acids 2-10 of BAGE | **QLVFSKLENGGFPYE**AARAVFLAL (SEQ ID NO: 716),<br>AARAVFLAL**QLVFSKLENGGFPYE**AARAVFLAL (SEQ ID NO: 717) |
| | amino acids 9-16 of GAGE-1,2 | **QLVFSKLENGGFPYE**YRPRPRRY (SEQ ID NO: 718),<br>YRPRPRRY**QLVFSKLENGGFPYE**YRPRPRRY (SEQ ID NO: 719) |
| | amino acids 11-20 of RAGE | **QLVFSKLENGGFPYE**SPSSNRIRNT (SEQ ID NO: 720),<br>SPSSNRIRNT**QLVFSKLENGGFPYE**SPSSNRIRNT (SEQ ID NO: 721) |
| | amino acids 23-32 of CDK4 | **QLVFSKLENGGFPYE**ACDPHSGHFV (SEQ ID NO: 722),<br>ACDPHSGHFV**QLVFSKLENGGFPYE**ACDPHSGHFV (SEQ ID NO: 723) |
| | amino acids 29-37 of β-catenin | **QLVFSKLENGGFPYE**SYLDSGIHF (SEQ ID NO: 724),<br>SYLDSGIHF**QLVFSKLENGGFPYE**SYLDSGIHF (SEQ ID NO: 725) |
| | amino acids 1-9 of tyrosinase | **QLVFSKLENGGFPYE**MLLAVLYCL (SEQ ID NO: 726),<br>MLLAVLYCL**QLVFSKLENGGFPYE**MLLAVLYCL (SEQ ID NO: 727) |
| | amino acids 206-214 of tyrosinase | **QLVFSKLENGGFPYE**AFLPWHRLF (SEQ ID NO: 728),<br>AFLPWHRLF**QLVFSKLENGGFPYE**AFLPWHRLF (SEQ ID NO: 729) |
| | amino acids 56-70 of tyrosinase | **QLVFSKLENGGFPYE**QNILLSNAPLGPQFP (SEQ ID NO: 730),<br>QNILLSNAPLGPQFP**QLVFSKLENGGFPYE**QNILLSNAPLGPQFP (SEQ ID NO: 731) |
| | amino acids 448-462 of tyrosinase | **QLVFSKLENGGFPYE**DYSYLQDSDPDSFQD (SEQ ID NO: 732),<br>DYSYLQDSDPDSFQD**QLVFSKLENGGFPYE**DYSYLQDSDPDSFQD (SEQ ID NO: 733) |
| | amino acids 32-40 of Melan-A$^{MART-1}$ | **QLVFSKLENGGFPYE**JLTVILGVL (SEQ ID NO: 734),<br>JLTVILGVL**QLVFSKLENGGFPYE**JLTVILGVL (SEQ ID NO: 735) |
| | amino acids 154-162 of gp100$^{Pmel17}$ | **QLVFSKLENGGFPYE**KTWGQYWQV (SEQ ID NO: 736),<br>KTWGQYWQV**QLVFSKLENGGFPYE**KTWGQYWQV (SEQ ID NO: 737) |
| | amino acids 209-217 of gp100$^{Pmel17}$ | **QLVFSKLENGGFPYE**ITDQVPFSV (SEQ ID NO: 738),<br>ITDQVPFSV**QLVFSKLENGGFPYE**ITDQVPFSV (SEQ ID NO: 739) |
| | amino acids 280-288 of gp100$^{Pmel17}$ | **QLVFSKLENGGFPYE**YLEPGPVTA (SEQ ID NO: 740),<br>YLEPGPVTA**QLVFSKLENGGFPYE**YLEPGPVTA (SEQ ID NO: 741) |
| | amino acids 457-466 of gp100$^{Pmel17}$ | **QLVFSKLENGGFPYE**LLDGTATLRL (SEQ ID NO: 742),<br>LLDGTATLRL**QLVFSKLENGGFPYE**LLDGTATLRL (SEQ ID NO: 743) |
| | amino acids 476-485 of gp100$^{Pmel17}$ | **QLVFSKLENGGFPYE**VLYRYGSFSV (SEQ ID NO: 744),<br>VLYRYGSFSV**QLVFSKLENGGFPYE**VLYRYGSFSV (SEQ ID NO: 745) |

TABLE B-continued

| C35 Peptide/Epitope | Exemplary Tumor Rejection Peptide | Exemplary Polytopes |
|---|---|---|
| | amino acids 301-309 of PRAME | **QLVFSKLENGGFPYE**LYVDSLFFL (SEQ ID NO: 746),<br>LYVDSLFFL**QLVFSKLENGGFPYE**LYVDSLFFL (SEQ ID NO: 747) |
| | amino acids 292-303 of MAGE-6 | **QLVFSKLENGGFPYE**KISGGPRISYPL (SEQ ID NO: 748),<br>KISGGPRISYPL**QLVFSKLENGGFPYE**KISGGPRISYPL (SEQ ID NO: 749) |
| | amino acids 157-167 of NY-ESO-1 | **QLVFSKLENGGFPYE**SLLMWITQCFL (SEQ ID NO: 750),<br>SLLMWITQCFL**QLVFSKLENGGFPYE**SLLMWITQCFL (SEQ ID NO: 751) |
| | amino acids 157-165 of NY-ESO-1 | **QLVFSKLENGGFPYE**SLLMWITQC (SEQ ID NO: 752),<br>SLLMWITQC**QLVFSKLENGGFPYE**SLLMWITQC (SEQ ID NO: 753) |
| | amino acids 155-163 of NY-ESO-1 | **QLVFSKLENGGFPYE**QLSLLMWIT (SEQ ID NO: 754),<br>QLSLLMWIT**QLVFSKLENGGFPYE**QLSLLMWIT (SEQ ID NO: 755) |
| | amino acids 157-170 of NY-ESO-1 and amino acids 281-295 of MAGE-3 | SLLMWITQCFLPVF**QLVFSKLENGGFPYE**TSYVKVLHHMVKISG (SEQ ID NO: 756) |
| G81-L89 of SEQ ID NO: 2<br>GGFPYEKDL | amino acids 161-169 of MAGE-1 | **GGFPYEKDL**EADPTGHSY (SEQ ID NO: 757),<br>EADPTGHSY**GGFPYEKDL**EADPTGHSY (SEQ ID NO: 758) |
| | amino acids 230-238 of MAGE-1 | **GGFPYEKDL**SAYGEPRKL (SEQ ID NO: 759),<br>SAYGEPRKL**GGFPYEKDL**SAYGEPRKL (SEQ ID NO: 760) |
| | amino acids 168-176 of MAGE-3 | **GGFPYEKDL**EVDPIGHLY (SEQ ID NO: 761),<br>EVDPIGHLY**GGFPYEKDL**EVDPIGHLY (SEQ ID NO: 762) |
| | amino acids 271-279 of MAGE-3 | **GGFPYEKDL**FLWGPRALV (SEQ ID NO: 763),<br>FLWGPRALV**GGFPYEKDL**FLWGPRALV (SEQ ID NO: 764) |
| | amino acids 167-176 of MAGE-3 | **GGFPYEKDL**MEVDPIGHLY (SEQ ID NO: 765),<br>MEVDPIGHLY**GGFPYEKDL**MEVDPIGHLY (SEQ ID NO: 766) |
| | amino acids 2-10 of BAGE | **GGFPYEKDL**AARAVFLAL (SEQ ID NO: 767),<br>AARAVFLAL**GGFPYEKDL**AARAVFLAL (SEQ ID NO: 768) |
| | amino acids 9-16 of GAGE-1,2 | **GGFPYEKDL**YRPRPRRY (SEQ ID NO: 769),<br>YRPRPRRY**GGFPYEKDL**YRPRPRRY (SEQ ID NO: 770) |
| | amino acids 11-20 of RAGE | **GGFPYEKDL**SPSSNRIRNT (SEQ ID NO: 771),<br>SPSSNRIRNT**GGFPYEKDL**SPSSNRIRNT (SEQ ID NO: 772) |
| | amino acids 23-32 of CDK4 | **GGFPYEKDL**ACDPHSGHFV (SEQ ID NO: 773),<br>ACDPHSGHFV**GGFPYEKDL**ACDPHSGHFV (SEQ ID NO: 774) |
| | amino acids 29-37 of β-catenin | **GGFPYEKDL**SYLDSGIHF (SEQ ID NO: 775),<br>SYLDSGIHF**GGFPYEKDL**SYLDSGIHF (SEQ ID NO: 776) |
| | amino acids 1-9 of tyrosinase | **GGFPYEKDL**MLLAVLYCL (SEQ ID NO: 777),<br>MLLAVLYCL**GGFPYEKDL**MLLAVLYCL (SEQ ID NO: 778) |

TABLE B-continued

| C35 Peptide/Epitope | Exemplary Tumor Rejection Peptide | Exemplary Polytopes |
|---|---|---|
| | amino acids 206-214 of tyrosinase | **GGFPYEKDL** AFLPWHRLF (SEQ ID NO: 779),<br>AFLPWHRLF**GGFPYEKDL**AFLPWHRLF (SEQ ID NO: 780) |
| | amino acids 56-70 of tyrosinase | **GGFPYEKDL**QNILLSNAPLGPQFP (SEQ ID NO: 781),<br>QNILLSNAPLGPQFP**GGFPYEKDL**QNILLSNAPLGPQFP (SEQ ID NO: 782) |
| | amino acids 448-462 of tyrosinase | **GGFPYEKDL**DYSYLQDSDPDSFQD (SEQ ID NO: 783),<br>DYSYLQDSDPDSFQD**GGFPYEKDL**DYSYLQDSDPDSFQD (SEQ ID NO: 784) |
| | amino acids 32-40 of Melan-A$^{MART-1}$ | **GGFPYEKDL**JLTVILGVL (SEQ ID NO: 785),<br>JLTVILGVL**GGFPYEKDL**JLTVILGVL (SEQ ID NO: 786) |
| | amino acids 154-162 of gp100$^{Pmel17}$ | **GGFPYEKDL**KTWGQYWQV (SEQ ID NO: 787),<br>KTWGQYWQV**GGFPYEKDL**KTWGQYWQV (SEQ ID NO: 788) |
| | amino acids 209-217 of gp100$^{Pmel17}$ | **GGFPYEKDL**ITDQVPFSV (SEQ ID NO: 789),<br>ITDQVPFSV**GGFPYEKDL**ITDQVPFSV (SEQ ID NO: 790) |
| | amino acids 280-288 of gp100$^{Pmel17}$ | **GGFPYEKDL**YLEPGPVTA (SEQ ID NO: 791),<br>YLEPGPVTA**GGFPYEKDL**YLEPGPVTA (SEQ ID NO: 792) |
| | amino acids 457-466 of gp100$^{Pmel17}$ | **GGFPYEKDL**LLDGTATLRL (SEQ ID NO: 793),<br>LLDGTATLRL**GGFPYEKDL**LLDGTATLRL (SEQ ID NO: 794) |
| | amino acids 476-485 of gp100$^{Pmel17}$ | **GGFPYEKDL**VLYRYGSFSV (SEQ ID NO: 795),<br>VLYRYGSFSV**GGFPYEKDL**VLYRYGSFSV (SEQ ID NO: 796) |
| | amino acids 301-309 of PRAME | **GGFPYEKDL**LYVDSLFFL (SEQ ID NO: 797),<br>LYVDSLFFL**GGFPYEKDL**LYVDSLFFL (SEQ ID NO: 798) |
| | amino acids 292-303 of MAGE-6 | **GGFPYEKDL**KISGGPRISYPL (SEQ ID NO: 799),<br>KISGGPRISYPL**GGFPYEKDL**KISGGPRISYPL (SEQ ID NO: 800) |
| | amino acids 157-167 of NY-ESO-1 | **GGFPYEKDL**SLLMWITQCFL (SEQ ID NO: 801),<br>SLLMWITQCFL**GGFPYEKDL**SLLMWITQCFL (SEQ ID NO: 802) |
| | amino acids 157-165 of NY-ESO-1 | **GGFPYEKDL**SLLMWITQC (SEQ ID NO: 803),<br>SLLMWITQC**GGFPYEKDL**SLLMWITQC (SEQ ID NO: 804) |
| | amino acids 155-163 of NY-ESO-1 | **GGFPYEKDL**QLSLLMWIT (SEQ ID NO: 805),<br>QLSLLMWIT**GGFPYEKDL**QLSLLMWIT (SEQ ID NO: 806) |
| | amino acids 157-170 of NY-ESO-1 and amino acids 281-295 of MAGE-3 | SLLMWITQCFLPVF**GGFPYEKDL**TSYVKVLHHMVKISG (SEQ ID NO: 807) |
| K104-C112 of SEQ ID NO: 2<br>KITNSRPPC | amino acids 161-169 of MAGE-1 | **KITNSRPPC**EADPTGHSY (SEQ ID NO: 808),<br>EADPTGHSY**KITNSRPPC**EADPTGHSY (SEQ ID NO: 809) |
| | amino acids 230-238 of MAGE-1 | **KITNSRPPC**SAYGEPRKL (SEQ ID NO: 810),<br>SAYGEPRKL**KITNSRPPC**SAYGEPRKL (SEQ ID NO: 811) |

TABLE B-continued

| C35 Peptide/Epitope | Exemplary Tumor Rejection Peptide | Exemplary Polytopes |
|---|---|---|
| | amino acids 168-176 of MAGE-3 | **KITNSRPPC**EVDPIGHLY (SEQ ID NO: 812),<br>EVDPIGHLY**KITNSRPPC**EVDPIGHLY (SEQ ID NO: 813) |
| | amino acids 271-279 of MAGE-3 | **KITNSRPPC**FLWGPRALV (SEQ ID NO: 814),<br>FLWGPRALV**KITNSRPPC**FLWGPRALV (SEQ ID NO: 815) |
| | amino acids 167-176 of MAGE-3 | **KITNSRPPC**MEVDPIGHLY (SEQ ID NO: 816),<br>MEVDPIGHLY**KITNSRPPC**MEVDPIGHLY (SEQ ID NO: 817) |
| | amino acids 2-10 of BAGE | **KITNSRPPC**AARAVFLAL (SEQ ID NO: 818),<br>AARAVFLAL**KITNSRPPC**AARAVFLAL (SEQ ID NO: 819) |
| | amino acids 9-16 of GAGE-1,2 | **KITNSRPPC**YRPRPRRY (SEQ ID NO: 820),<br>YRPRPRRY**KITNSRPPC**YRPRPRRY (SEQ ID NO: 821) |
| | amino acids 11-20 of RAGE | **KITNSRPPC**SPSSNRIRNT (SEQ ID NO: 822),<br>SPSSNRIRNT**KITNSRPPC**SPSSNRIRNT (SEQ ID NO: 823) |
| | amino acids 23-32 of CDK4 | **KITNSRPPC**ACDPHSGHFV (SEQ ID NO: 824),<br>ACDPHSGHFV**KITNSRPPC**ACDPHSGHFV (SEQ ID NO: 825) |
| | amino acids 29-37 of β-catenin | **KITNSRPPC**SYLDSGIHF (SEQ ID NO: 826),<br>SYLDSGIHF**KITNSRPPC**SYLDSGIHF (SEQ ID NO: 827) |
| | amino acids 1-9 of tyrosinase | **KITNSRPPC**MLLAVLYCL (SEQ ID NO: 828),<br>MLLAVLYCL**KITNSRPPC**MLLAVLYCL (SEQ ID NO: 829) |
| | amino acids 206-214 of tyrosinase | **KITNSRPPC**AFLPWHRLF (SEQ ID NO: 830),<br>AFLPWHRLF**KITNSRPPC**AFLPWHRLF (SEQ ID NO: 831) |
| | amino acids 56-70 of tyrosinase | **KITNSRPPC**QNILLSNAPLGPQFP (SEQ ID NO: 832),<br>QNILLSNAPLGPQFP**KITNSRPPC**QNILLSNAPLGPQFP (SEQ ID NO: 833) |
| | amino acids 448-462 of tyrosinase | **KITNSRPPC**DYSYLQDSDPDSFQD (SEQ ID NO: 834),<br>DYSYLQDSDPDSFQD**KITNSRPPC**DYSYLQDSDPDSFQD (SEQ ID NO: 835) |
| | amino acids 32-40 of Melan-A$^{MART-1}$ | **KITNSRPPC**JLTVILGVL (SEQ ID NO: 836),<br>JLTVILGVL**KITNSRPPC**JLTVILGVL (SEQ ID NO: 837) |
| | amino acids 154-162 of gp100$^{Pme117}$ | **KITNSRPPC**KTWGQYWQV (SEQ ID NO: 838),<br>KTWGQYWQV**KITNSRPPC**KTWGQYWQV (SEQ ID NO: 839) |
| | amino acids 209-217 of gp100$^{Pme117}$ | **KITNSRPPC**ITDQVPFSV (SEQ ID NO: 840),<br>ITDQVPFSV**KITNSRPPC**ITDQVPFSV (SEQ ID NO: 841) |
| | amino acids 280-288 of gp100$^{Pme117}$ | **KITNSRPPC**YLEPGPVTA (SEQ ID NO: 842),<br>YLEPGPVTA**KITNSRPPC**YLEPGPVTA (SEQ ID NO: 843) |
| | amino acids 457-466 of gp100$^{Pme117}$ | **KITNSRPPC**LLDGTATLRL (SEQ ID NO: 844),<br>LLDGTATLRL**KITNSRPPC**LLDGTATLRL (SEQ ID NO: 845) |

TABLE B-continued

| C35 Peptide/Epitope | Exemplary Tumor Rejection Peptide | Exemplary Polytopes |
|---|---|---|
| | amino acids 476-485 of gp100$^{Pmel17}$ | **KITNSRPPC**VLYRYGSFSV (SEQ ID NO: 846),<br>VLYRYGSFSV**KITNSRPPC**VLYRYGSFSV (SEQ ID NO: 847) |
| | amino acids 301-309 of PRAME | **KITNSRPPC**LYVDSLFFL (SEQ ID NO: 848),<br>LYVDSLFFL**KITNSRPPC**LYVDSLFFL (SEQ ID NO: 849) |
| | amino acids 292-303 of MAGE-6 | **KITNSRPPC**KISGGPRISYPL (SEQ ID NO: 850),<br>KISGGPRISYPL**KITNSRPPC**KISGGPRISYPL (SEQ ID NO: 851) |
| | amino acids 157-167 of NY-ESO-1 | **KITNSRPPC**SLLMWITQCFL (SEQ ID NO: 852),<br>SLLMWITQCFL**KITNSRPPC**SLLMWITQCFL (SEQ ID NO: 853) |
| | amino acids 157-165 of NY-ESO-1 | **KITNSRPPC**SLLMWITQC (SEQ ID NO: 854),<br>SLLMWITQC**KITNSRPPC**SLLMWITQC (SEQ ID NO: 855) |
| | amino acids 155-163 of NY-ESO-1 | **KITNSRPPC**QLSLLMWIT (SEQ ID NO: 856),<br>QLSLLMWIT**KITNSRPPC**QLSLLMWIT (SEQ ID NO: 857) |
| | amino acids 157-170 of NY-ESO-1 and amino acids 281-295 of MAGE-3 | SLLMWITQCFLPVF**KITNSRPPC**TSYVKVLHHMVKISG (SEQ ID NO: 858) |
| K104-V113 of SEQ ID NO: 2 KITNSRPPCV | amino acids 161-169 of MAGE-1 | **KITNSRPPCV**EADPTGHSY (SEQ ID NO: 859),<br>EADPTGHSY**KITNSRPPCV**EADPTGHSY (SEQ ID NO: 860) |
| | amino acids 230-238 of MAGE-1 | **KITNSRPPCV**SAYGEPRKL (SEQ ID NO: 861),<br>SAYGEPRKL**KITNSRPPCV**SAYGEPRKL (SEQ ID NO: 862) |
| | amino acids 168-176 of MAGE-3 | **KITNSRPPCV**EVDPIGHLY (SEQ ID NO: 863),<br>EVDPIGHLY**KITNSRPPCV**EVDPIGHLY (SEQ ID NO: 864) |
| | amino acids 271-279 of MAGE-3 | **KITNSRPPCV**FLWGPRALV (SEQ ID NO: 865),<br>FLWGPRALV**KITNSRPPCV**FLWGPRALV (SEQ ID NO: 866) |
| | amino acids 167-176 of MAGE-3 | **KITNSRPPCV**MEVDPIGHLY (SEQ ID NO: 867),<br>MEVDPIGHLY**KITNSRPPCV**MEVDPIGHLY (SEQ ID NO: 868) |
| | amino acids 2-10 of BAGE | **KITNSRPPCV**AARAVFLAL (SEQ ID NO: 869),<br>AARAVFLAL**KITNSRPPCV**AARAVFLAL (SEQ ID NO: 870) |
| | amino acids 9-16 of GAGE-1,2 | **KITNSRPPCV**YRPRPRRY (SEQ ID NO: 871),<br>YRPRPRRY**KITNSRPPCV**YRPRPRRY (SEQ ID NO: 872) |
| | amino acids 11-20 of RAGE | **KITNSRPPCV**SPSSNRIRNT (SEQ ID NO: 873),<br>SPSSNRIRNT**KITNSRPPCV**SPSSNRIRNT (SEQ ID NO: 874) |
| | amino acids 23-32 of CDK4 | **KITNSRPPCV**ACDPHSGHFV (SEQ ID NO: 875),<br>ACDPHSGHFV**KITNSRPPCV**ACDPHSGHFV (SEQ ID NO: 876) |
| | amino acids 29-37 of β-catenin | **KITNSRPPCV**SYLDSGIHF (SEQ ID NO: 877),<br>SYLDSGIHF**KITNSRPPCV**SYLDSGIHF (SEQ ID NO: 878) |

TABLE B-continued

| C35 Peptide/Epitope | Exemplary Tumor Rejection Peptide | Exemplary Polytopes |
|---|---|---|
| | amino acids 1-9 of tyrosinase | **KITNSRPPCV**MLLAVLYCL (SEQ ID NO: 879),<br>MLLAVLYCL**KITNSRPPCV**MLLAVLYCL (SEQ ID NO: 880) |
| | amino acids 206-214 of tyrosinase | **KITNSRPPCV**AFLPWHRLF (SEQ ID NO: 881),<br>AFLPWHRLF**KITNSRPPCV**AFLPWHRLF (SEQ ID NO: 882) |
| | amino acids 56-70 of tyrosinase | **KITNSRPPCV**QNILLSNAPLGPQFP (SEQ ID NO: 883),<br>QNILLSNAPLGPQFP**KITNSRPPCV**QNILLSNAPLGPQFP (SEQ ID NO: 884) |
| | amino acids 448-462 of tyrosinase | **KITNSRPPCV**DYSYLQDSDPDSFQD (SEQ ID NO: 885),<br>DYSYLQDSDPDSFQD**KITNSRPPCV**DYSYLQDSDPDSFQD (SEQ ID NO: 886) |
| | amino acids 32-40 of Melan-A$^{MART-1}$ | **KITNSRPPCV**JLTVILGVL (SEQ ID NO: 887),<br>JLTVILGVL**KITNSRPPCV**JLTVILGVL (SEQ ID NO: 888) |
| | amino acids 154-162 of gp100$^{Pmel17}$ | **KITNSRPPCV**KTWGQYWQV (SEQ ID NO: 889),<br>KTWGQYWQV**KITNSRPPCV**KTWGQYWQV (SEQ ID NO: 890) |
| | amino acids 209-217 of gp100$^{Pmel17}$ | **KITNSRPPCV**ITDQVPFSV (SEQ ID NO: 891),<br>ITDQVPFSV**KITNSRPPCV**ITDQVPFSV (SEQ ID NO: 892) |
| | amino acids 280-288 of gp100$^{Pmel17}$ | **KITNSRPPCV**YLEPGPVTA (SEQ ID NO: 893),<br>YLEPGPVTA**KITNSRPPCV**YLEPGPVTA (SEQ ID NO: 894) |
| | amino acids 457-466 of gp100$^{Pmel17}$ | **KITNSRPPCV**LLDGTATLRL (SEQ ID NO: 895),<br>LLDGTATLRL**KITNSRPPCV**LLDGTATLRL (SEQ ID NO: 896) |
| | amino acids 476-485 of gp100$^{Pmel17}$ | **KITNSRPPCV**VLYRYGSFSV (SEQ ID NO: 897),<br>VLYRYGSFSV**KITNSRPPCV**VLYRYGSFSV (SEQ ID NO: 898) |
| | amino acids 301-309 of PRAME | **KITNSRPPCV**LYVDSLFFL (SEQ ID NO: 899),<br>LYVDSLFFL**KITNSRPPCV**LYVDSLFFL (SEQ ID NO: 900) |
| | amino acids 292-303 of MAGE-6 | **KITNSRPPCV**KISGGPRISYPL (SEQ ID NO: 901),<br>KISGGPRISYPL**KITNSRPPCV**KISGGPRISYPL (SEQ ID NO: 902) |
| | amino acids 157-167 of NY-ESO-1 | **KITNSRPPCV**SLLMWITQCFL (SEQ ID NO: 903),<br>SLLMWITQCFL**KITNSRPPCV**SLLMWITQCFL (SEQ ID NO: 904) |
| | amino acids 157-165 of NY-ESO-1 | **KITNSRPPCV**SLLMWITQC (SEQ ID NO: 905),<br>SLLMWITQC**KITNSRPPCV**SLLMWITQC (SEQ ID NO: 906) |
| | amino acids 155-163 of NY-ESO-1 | **KITNSRPPCV**QLSLLMWIT (SEQ ID NO: 907),<br>QLSLLMWIT**KITNSRPPCV**QLSLLMWIT (SEQ ID NO: 908) |
| | amino acids 157-170 of NY-ESO-1 and amino acids 281-295 of MAGE-3 | SLLMWITQCFLPVF**KITNSRPPCV**TSYVKVLHHMVKISG (SEQ ID NO: 909) |

TABLE B-continued

| C35 Peptide/Epitope | Exemplary Tumor Rejection Peptide | Exemplary Polytopes |
|---|---|---|
| I105-V113 of SEQ ID NO: 2<br>ITNSRPPCV | amino acids 161-169 of MAGE-1 | **ITNSRPPCV**EADPTGHSY (SEQ ID NO: 910),<br>EADPTGHSY**ITNSRPPCV**EADPTGHSY (SEQ ID NO: 911) |
| | amino acids 230-238 of MAGE-1 | **ITNSRPPCV**SAYGEPRKL (SEQ ID NO: 912),<br>SAYGEPRKL**ITNSRPPCV**SAYGEPRKL (SEQ ID NO: 913) |
| | amino acids 168-176 of MAGE-3 | **ITNSRPPCV**EVDPIGHLY (SEQ ID NO: 914),<br>EVDPIGHLY**ITNSRPPCV**EVDPIGHLY (SEQ ID NO: 915) |
| | amino acids 271-279 of MAGE-3 | **ITNSRPPCV**FLWGPRALV (SEQ ID NO: 916),<br>FLWGPRALV**ITNSRPPCV**FLWGPRALV (SEQ ID NO: 917) |
| | amino acids 167-176 of MAGE-3 | **ITNSRPPCV**MEVDPIGHLY (SEQ ID NO: 918),<br>MEVDPIGHLY**ITNSRPPCV**MEVDPIGHLY (SEQ ID NO: 919) |
| | amino acids 2-10 of BAGE | **ITNSRPPCV**AARAVFLAL (SEQ ID NO: 920),<br>AARAVFLAL**ITNSRPPCV**AARAVFLAL (SEQ ID NO: 921) |
| | amino acids 9-16 of GAGE-1,2 | **ITNSRPPCV**YRPRPRRY (SEQ ID NO: 922),<br>YRPRPRRY**ITNSRPPCV**YRPRPRRY (SEQ ID NO: 923) |
| | amino acids 11-20 of RAGE | **ITNSRPPCV**SPSSNRIRNT (SEQ ID NO: 924),<br>SPSSNRIRNT**ITNSRPPCV**SPSSNRIRNT (SEQ ID NO: 925) |
| | amino acids 23-32 of CDK4 | **ITNSRPPCV**ACDPHSGHFV (SEQ ID NO: 926),<br>ACDPHSGHFV**ITNSRPPCV**ACDPHSGHFV (SEQ ID NO: 927) |
| | amino acids 29-37 of β-catenin | **ITNSRPPCV**SYLDSGIHF (SEQ ID NO: 928),<br>SYLDSGIHF**ITNSRPPCV**SYLDSGIHF (SEQ ID NO: 929) |
| | amino acids 1-9 of tyrosinase | **ITNSRPPCV**MLLAVLYCL (SEQ ID NO: 930),<br>MLLAVLYCL**ITNSRPPCV**MLLAVLYCL (SEQ ID NO: 931) |
| | amino acids 206-214 of tyrosinase | **ITNSRPPCV**AFLPWHRLF (SEQ ID NO: 932),<br>AFLPWHRLF**ITNSRPPCV**AFLPWHRLF (SEQ ID NO: 933) |
| | amino acids 56-70 of tyrosinase | **ITNSRPPCV**QNILLSNAPLGPQFP (SEQ ID NO: 934),<br>QNILLSNAPLGPQFP**ITNSRPPCV**QNILLSNAPLGPQFP (SEQ ID NO: 935) |
| | amino acids 448-462 of tyrosinase | **ITNSRPPCV**DYSYLQDSDPDSFQD (SEQ ID NO: 936),<br>DYSYLQDSDPDSFQD**ITNSRPPCV**DSYLQDSDPDSFQD (SEQ ID NO: 937) |
| | amino acids 32-40 of Melan-A$^{MART-1}$ | **ITNSRPPCV**JLTVILGVL (SEQ ID NO: 938),<br>JLTVILGVL**ITNSRPPCV**JLTVILGVL (SEQ ID NO: 939) |
| | amino acids 154-162 of gp100$^{Pmel17}$ | **ITNSRPPCV**KTWGQYWQV (SEQ ID NO: 940),<br>KTWGQYWQV**ITNSRPPCV**KTWGQYWQV (SEQ ID NO: 941) |
| | amino acids 209-217 of gp100$^{Pmel17}$ | **ITNSRPPCV**ITDQVPFSV (SEQ ID NO: 942),<br>ITDQVPFSV**ITNSRPPCV**ITDQVPFSV (SEQ ID NO: 943) |

TABLE B-continued

| C35 Peptide/Epitope | Exemplary Tumor Rejection Peptide | Exemplary Polytopes |
|---|---|---|
| | amino acids 280-288 of gp100$^{Pmel17}$ | **ITNSRPPCV**YLEPGPVTA (SEQ ID NO: 944),<br>YLEPGPVTA**ITNSRPPCV**YLEPGPVTA (SEQ ID NO: 945) |
| | amino acids 457-466 of gp100$^{Pmel17}$ | **ITNSRPPCV**LLDGTATLRL (SEQ ID NO: 946),<br>LLDGTATLRL**ITNSRPPCV**LLDGTATLRL (SEQ ID NO: 947) |
| | amino acids 476-485 of gp100$^{Pmel17}$ | **ITNSRPPCV**VLYRYGSFSV (SEQ ID NO: 948),<br>VLYRYGSFSV**ITNSRPPCV**VLYRYGSFSV (SEQ ID NO: 949) |
| | amino acids 301-309 of PRAME | **ITNSRPPCV**LYVDSLFFL (SEQ ID NO: 950),<br>LYVDSLFFL**ITNSRPPCV**LYVDSLFFL (SEQ ID NO: 951) |
| | amino acids 292-303 of MAGE-6 | **ITNSRPPCV**KISGGPRISYPL (SEQ ID NO: 952),<br>KISGGPRISYPL**ITNSRPPCV**KISGGPRISYPL (SEQ ID NO: 953) |
| | amino acids 157-167 of NY-ESO-1 | **ITNSRPPCV**SLLMWITQCFL (SEQ ID NO: 954),<br>SLLMWITQCFL**ITNSRPPCV**SLLMWITQCFL (SEQ ID NO: 955) |
| | amino acids 157-165 of NY-ESO-1 | **ITNSRPPCV**SLLMWITQC (SEQ ID NO: 956),<br>SLLMWITQC**ITNSRPPCV**SLLMWITQC (SEQ ID NO: 957) |
| | amino acids 155-163 of NY-ESO-1 | **ITNSRPPCV**QLSLLMWIT (SEQ ID NO: 958),<br>QLSLLMWIT**ITNSRPPCV**QLSLLMWIT (SEQ ID NO: 959) |
| | amino acids 157-170 of NY-ESO-1 and amino acids 281-295 of MAGE-3 | SLLMWITQCFLPVF**ITNSRPPCV**TSYVKVLHHMVKISG (SEQ ID NO: 960) |
| T101-V113 of SEQ ID NO: 2<br>TLEKITNSRPPCV | amino acids 161-169 of MAGE-1 | **TLEKITNSRPPCV**EADPTGHSY (SEQ ID NO: 961),<br>EADPTGHSY**TLEKITNSRPPCV**EADPTGHSY (SEQ ID NO: 962) |
| | amino acids 230-238 of MAGE-1 | **TLEKITNSRPPCV**SAYGEPRKL (SEQ ID NO: 963),<br>SAYGEPRKL**TLEKITNSRPPCV**SAYGEPRKL (SEQ ID NO: 964) |
| | amino acids 168-176 of MAGE-3 | **TLEKITNSRPPCV**EVDPIGHLY (SEQ ID NO: 965),<br>EVDPIGHLY **TLEKITNSRPPCV**EVDPIGHLY (SEQ ID NO: 966) |
| | amino acids 271-279 of MAGE-3 | **TLEKITNSRPPCV**FLWGPRALV (SEQ ID NO: 967),<br>FLWGPRALV**TLEKITNSRPPCV**FLWGPRALV (SEQ ID NO: 968) |
| | amino acids 167-176 of MAGE-3 | **TLEKITNSRPPCV**MEVDPIGHLY (SEQ ID NO: 969),<br>MEVDPIGHLY**TLEKITNSRPPCV**MEVDPIGHLY (SEQ ID NO: 970) |
| | amino acids 2-10 of BAGE | **TLEKITNSRPPCV**AARAVFLAL (SEQ ID NO: 971),<br>AARAVFLAL**TLEKITNSRPPCV**AARAVFLAL (SEQ ID NO: 972) |
| | amino acids 9-16 of GAGE-1,2 | **TLEKITNSRPPCV**YRPRPRRY (SEQ ID NO: 973),<br>YRPRPRRY**TLEKITNSRPPCV**YRPRPRRY (SEQ ID NO: 974) |
| | amino acids 11-20 of RAGE | **TLEKITNSRPPCV**SPSSNRIRNT (SEQ ID NO: 975),<br>SPSSNRIRNT**TLEKITNSRPPCV**SPSSNRIRNT (SEQ ID NO: 976) |

TABLE B-continued

| C35 Peptide/Epitope | Exemplary Tumor Rejection Peptide | Exemplary Polytopes |
|---|---|---|
| | amino acids 23-32 of CDK4 | **TLEKITNSRPPCV**ACDPHSGHFV (SEQ ID NO: 977),<br>ACDPHSGHFV**TLEKITNSRPPCV**ACDPHSGHFV (SEQ ID NO: 978) |
| | amino acids 29-37 of β-catenin | **TLEKITNSRPPCV**SYLDSGIHF (SEQ ID NO: 979),<br>SYLDSGIHF**TLEKITNSRPPCV**SYLDSGIHF (SEQ ID NO: 980) |
| | amino acids 1-9 of tyrosinase | **TLEKITNSRPPCV**MLLAVLYCL (SEQ ID NO: 981),<br>MLLAVLYCL**TLEKITNSRPPCV**MLLAVLYCL (SEQ ID NO: 982) |
| | amino acids 206-214 of tyrosinase | **TLEKITNSRPPCV**AFLPWHRLF (SEQ ID NO: 983),<br>AFLPWHRLF**TLEKITNSRPPCV**AFLPWHRLF (SEQ ID NO: 984) |
| | amino acids 56-70 of tyrosinase | **TLEKITNSRPPCV**QNILLSNAPLGPQFP (SEQ ID NO: 985),<br>QNILLSNAPLGPQFP**TLEKITNSRPPCV**QNILLSNAPLGPQFP (SEQ ID NO: 986) |
| | amino acids 448-462 of tyrosinase | **TLEKITNSRPPCV**DYSYLQDSDPDSFQD (SEQ ID NO: 987),<br>DYSYLQDSDPDSFQD**TLEKITNSRPPCV**DYSYLQDSDPDSFQD (SEQ ID NO: 988) |
| | amino acids 32-40 of Melan-$A^{MART-1}$ | **TLEKITNSRPPCV**JLTVILGVL (SEQ ID NO: 989),<br>JLTVILGVL**TLEKITNSRPPCV**JLTVILGVL (SEQ ID NO: 990) |
| | amino acids 154-162 of $gp100^{Pmel17}$ | **TLEKITNSRPPCV**KTWGQYWQV (SEQ ID NO: 991),<br>KTWGQYWQV**TLEKITNSRPPCV**KTWGQYWQV (SEQ ID NO: 992) |
| | amino acids 209-217 of $gp100^{Pmel17}$ | **TLEKITNSRPPCV**ITDQVPFSV (SEQ ID NO: 993),<br>ITDQVPFSV**TLEKITNSRPPCV**ITDQVPFSV (SEQ ID NO: 994) |
| | amino acids 280-288 of $gp100^{Pmel17}$ | **TLEKITNSRPPCV**YLEPGPVTA (SEQ ID NO: 995),<br>YLEPGPVTA**TLEKITNSRPPCV**YLEPGPVTA (SEQ ID NO: 996) |
| | amino acids 457-466 of $gp100^{Pmel17}$ | **TLEKITNSRPPCV**LLDGTATLRL (SEQ ID NO: 997),<br>LLDGTATLRL**TLEKITNSRPPCV**LLDGTATLRL (SEQ ID NO: 998) |
| | amino acids 476-485 of $gp100^{Pmel17}$ | **TLEKITNSRPPCV**VLYRYGSFSV (SEQ ID NO: 999),<br>VLYRYGSFSV**TLEKITNSRPPCV**VLYRYGSFSV (SEQ ID NO: 1000) |
| | amino acids 301-309 of PRAME | **TLEKITNSRPPCV**LYVDSLFFL (SEQ ID NO: 1001),<br>LYVDSLFFL**TLEKITNSRPPCV**LYVDSLFFL (SEQ ID NO: 1002) |
| | amino acids 292-303 of MAGE-6 | **TLEKITNSRPPCV**KISGGPRISYPL (SEQ ID NO: 1003),<br>KISGGPRISYPL**TLEKITNSRPPCV**KISGGPRISYPL (SEQ ID NO: 1004) |
| | amino acids 157-167 of NY-ESO-1 | **TLEKITNSRPPCV**SLLMWITQCFL (SEQ ID NO: 1005),<br>SLLMWITQCFL**TLEKITNSRPPCV**SLLMWITQCFL (SEQ ID NO: 1006) |
| | amino acids 157-165 of NY-ESO-1 | **TLEKITNSRPPCV**SLLMWITQC (SEQ ID NO: 1007),<br>SLLMWITQC**TLEKITNSRPPCV**SLLMWITQC (SEQ ID NO: 1008) |

TABLE B-continued

| C35 Peptide/Epitope | Exemplary Tumor Rejection Peptide | Exemplary Polytopes |
|---|---|---|
| | amino acids 155-163 of NY-ESO-1 | **TLEKITNSRPPCV**QLSLLMWIT (SEQ ID NO: 1009),<br>QLSLLMWIT**TLEKITNSRPPCV**QLSLLMWIT (SEQ ID NO: 1010) |
| | amino acids 157-170 of NY-ESO-1 and amino acids 281-295 of MAGE-3 | SLLMWITQCFLPVF **TLEKITNSRPPCV**TSYVKVLHHMVKISG (SEQ ID NO: 1011) |
| 193-V113 of SEQ ID NO: 2 IRRASNGETLEKITNSRPPCV | amino acids 161-169 of MAGE-1 | **IRRASNGETLEKITNSRPPCV**EADPTGHSY (SEQ ID NO: 1012),<br>EADPTGHSY**IRRASNGETLEKITNSRPPCV**EADPTGHSY (SEQ ID NO: 1013) |
| | amino acids 230-238 of MAGE-1 | **IRRASNGETLEKITNSRPPCV**SAYGEPRKL (SEQ ID NO: 1014),<br>SAYGEPRKL**IRRASNGETLEKITNSRPPCV**SAYGEPRKL (SEQ ID NO: 1015) |
| | amino acids 168-176 of MAGE-3 | **IRRASNGETLEKITNSRPPCV**EVDPIGHLY (SEQ ID NO: 1016),<br>EVDPIGHLY**IRRASNGETLEKITNSRPPCV**EVDPIGHLY (SEQ ID NO: 1017) |
| | amino acids 271-279 of MAGE-3 | **IRRASNGETLEKITNSRPPCV**FLWGPRALV (SEQ ID NO: 1018),<br>FLWGPRALV**IRRASNGETLEKITNSRPPCV**FLWGPRALV (SEQ ID NO: 1019) |
| | amino acids 167-176 of MAGE-3 | **IRRASNGETLEKITNSRPPCV**MEVDPIGHLY (SEQ ID NO: 1020),<br>MEVDPIGHLY**IRRASNGETLEKITNSRPPCV**MEVDPIGHLY (SEQ ID NO: 1021) |
| | amino acids 2-10 of BAGE | **IRRASNGETLEKITNSRPPCV**AARAVFLAL (SEQ ID NO: 1022),<br>AARAVFLAL**IRRASNGETLEKITNSRPPCV**AARAVFLAL (SEQ ID NO: 1023) |
| | amino acids 9-16 of GAGE-1,2 | **IRRASNGETLEKITNSRPPCV**YRPRPRRY (SEQ ID NO: 1024),<br>YRPRPRRY**IRRASNGETLEKITNSRPPCV**YRPRPRRY (SEQ ID NO: 1025) |
| | amino acids 11-20 of RAGE | **IRRASNGETLEKITNSRPPCV**SPSSNRIRNT (SEQ ID NO: 1026),<br>SPSSNRIRNT**IRRASNGETLEKITNSRPPCV**SPSSNRIRNT (SEQ ID NO: 1027) |
| | amino acids 23-32 of CDK4 | **IRRASNGETLEKITNSRPPCV**ARDPHSGHFV (SEQ ID NO: 1028),<br>ARDPHSGHFV**IRRASNGETLEKITNSRPPCV**ARDPHSGHFV (SEQ ID NO: 1029) |
| | amino acids 29-37 of β-catenin | **IRRASNGETLEKITNSRPPCV**SYLDSGIHS (SEQ ID NO: 1030),<br>SYLDSGIHS**IRRASNGETLEKITNSRPPCV** SYLDSGIHS (SEQ ID NO: 1031) |
| | amino acids 1-9 of tyrosinase | **IRRASNGETLEKITNSRPPCV**MLLAVLYCL (SEQ ID NO: 1032),<br>MLLAVLYCL**IRRASNGETLEKITNSRPPCV**MLLAVLYCL (SEQ ID NO: 1033) |
| | amino acids 206-214 of tyrosinase | **IRRASNGETLEKITNSRPPCV**AFLPWHRLF (SEQ ID NO: 1034),<br>AFLPWHRLF**IRRASNGETLEKITNSRPPCV**AFLPWHRLF (SEQ ID NO: 1035) |
| | amino acids 56-70 of tyrosinase | **IRRASNGETLEKITNSRPPCV**QNILLSNAPLGPQFP (SEQ ID NO: 1036),<br>QNILLSNAPLGPQFP**IRRASNGETLEKITNSRPPCV**QNILLSNAPLGPQFP (SEQ ID NO: 1037) |
| | amino acids 448-462 of tyrosinase | **IRRASNGETLEKITNSRPPCV**DYSYLQDSDPDSFQD (SEQ ID NO: 1038),<br>DYSYLQDSDPDSFQD**IRRASNGETLEKITNSRPPCV**DYSYLQDSDPDSFQD (SEQ ID NO: 1039) |
| | amino acids 32-40 of Melan-A$^{MART-1}$ | **IRRASNGETLEKITNSRPPCV**JLTVILGVL (SEQ ID NO: 1040)<br>JLTVILGVL**IRRASNGETLEKITNSRPPCV** JLTVILGVL (SEQ ID NO: 1041) |

TABLE B-continued

| C35 Peptide/Epitope | Exemplary Tumor Rejection Peptide | Exemplary Polytopes |
|---|---|---|
| | amino acids 154-162 of gp100$^{Pmel17}$ | **IRRASNGETLEKITNSRPPCV**KTWGQYWQV (SEQ ID NO: 1042),<br>KTWGQYWQV**IRRASNGETLEKITNSRPPCV**KTWGQYWQV (SEQ ID NO: 1043) |
| | amino acids 209-217 of gp100$^{Pmel17}$ | **IRRASNGETLEKITNSRPPCV**ILITDQVPFSV (SEQ ID NO: 1044),<br>ITDQVPFSV**IRRASNGETLEKITNSRPPCV**ILITDQVPFSV (SEQ ID NO: 1045) |
| | amino acids 280-288 of gp100$^{Pmel17}$ | **IRRASNGETLEKITNSRPPCV**YLEPGPVTA (SEQ ID NO: 1046),<br>YLEPGPVTA**IRRASNGETLEKITNSRPPCV**YLEPGPVTA (SEQ ID NO: 1047) |
| | amino acids 457-466 of gp100$^{Pmel17}$ | **IRRASNGETLEKITNSRPPCV**LLDGTATLRL (SEQ ID NO: 1048),<br>LLDGTATLRL**IRRASNGETLEKITNSRPPCV**LLDGTATLRL (SEQ ID NO: 1049) |
| | amino acids 476-485 of gp100$^{Pmel17}$ | **IRRASNGETLEKITNSRPPCV**VLYRYGSFSV (SEQ ID NO: 1050),<br>VLYRYGSFSV**IRRASNGETLEKITNSRPPCV**VLYRYGSFSV (SEQ ID NO: 1051) |
| | amino acids 301-309 of PRAME | **IRRASNGETLEKITNSRPPCV**LYVDSLFFL (SEQ ID NO: 1052),<br>LYVDSLFFL**IRRASNGETLEKITNSRPPCV**LYVDSLFFL (SEQ ID NO: 1053) |
| | amino acids 292-303 of MAGE-6 | **IRRASNGETLEKITNSRPPCV**KISGGPRISYPL (SEQ ID NO: 1054),<br>KISGGPRISYPL**IRRASNGETLEKITNSRPPCV**KISGGPRISYPL (SEQ ID NO: 1055) |
| | amino acids 157-167 of NY-ESO-1 | **IRRASNGETLEKITNSRPPCV**SLLMWITQCFL (SEQ ID NO: 1056),<br>SLLMWITQCFL**IRRASNGETLEKITNSRPPCV**SLLMWITQCFL (SEQ ID NO: 1057) |
| | amino acids 157-165 of NY-ESO-1 | **IRRASNGETLEKITNSRPPCV**SLLMWITQC (SEQ ID NO: 1058),<br>SLLMWITQC**IRRASNGETLEKITNSRPPCV**SLLMWITQC (SEQ ID NO: 1059) |
| | amino acids 155-163 of NY-ESO-1 | **IRRASNGETLEKITNSRPPCV**QLSLLMWIT (SEQ ID NO: 1060),<br>QLSLLMWIT**IRRASNGETLEKITNSRPPCV**QLSLLMWIT (SEQ ID NO: 1061) |
| | amino acids 157-170 of NY-ESO-1 and amino acids 281-295 of MAGE-3 | SLLMWITQCFLPVF**IRRASNGETLEKITNSRPPCV**TSYVKVLHHMVKISG (SEQ ID NO: 1062) |
| D88-V113 of SEQ ID NO: 2 DLIEAIRRASNGETLEKITN SRPPCV | amino acids 161-169 of MAGE-1 | **DLIEAIRRASNGETLEKITNSRPPCV**EADPTGHSY (SEQ ID NO: 1063),<br>EADPTGHSY**DLIEAIRRASNGETLEKITNSRPPCV**EADPTGHSY (SEQ ID NO: 1064) |
| | amino acids 230-238 of MAGE-1 | **DLIEAIRRASNGETLEKITNSRPPCV**SAYGEPRKL (SEQ ID NO: 1065),<br>SAYGEPRKL**DLIEAIRRASNGETLEKITNSRPPCV**SAYGEPRKL (SEQ ID NO: 1066) |
| | amino acids 168-176 of MAGE-3 | **DLIEAIRRASNGETLEKITNSRPPCV**EVDPIGHLY (SEQ ID NO: 1067),<br>EVDPIGHLY**DLIEAIRRASNGETLEKITNSRPPCV**EVDPIGHLY (SEQ ID NO: 1068) |
| | amino acids 271-279 of MAGE-3 | **DLIEAIRRASNGETLEKITNSRPPCV**FLWGPRALV (SEQ ID NO: 1069),<br>FLWGPRALV**DLIEAIRRASNGETLEKITNSRPPCV**FLWGPRALV (SEQ ID NO: 1070) |
| | amino acids 167-176 of MAGE-3 | **DLIEAIRRASNGETLEKITNSRPPCV**MEVDPIGHLY (SEQ ID NO: 1071),<br>MEVDPIGHLY**DLIEAIRRASNGETLEKITNSRPPCV**MEVDPIGHLY (SEQ ID NO: 1072) |
| | amino acids 2-10 of BAGE | **DLIEAIRRASNGETLEKITNSRPPCV**AARAVFLAL (SEQ ID NO: 1073),<br>AARAVFLAL**DLIEAIRRASNGETLEKITNSRPPCV**AAR4VFLAL (SEQ ID NO: 1074) |

TABLE B-continued

| C35 Peptide/Epitope | Exemplary Tumor Rejection Peptide | Exemplary Polytopes |
|---|---|---|
| | amino acids 9-16 of GAGE-1,2 | **DLIEAIRRASNGETLEKITNSRPPCV**YRPRPRRY (SEQ ID NO: 1075),<br>YRPRPRRY**DLIEAIRRASNGETLEKITNSRPPCV**YRPRPRRY (SEQ ID NO: 1076) |
| | amino acids 11-20 of RAGE | **DLIEAIRRASNGETLEKITNSRPPCV**SPSSNRIRNT (SEQ ID NO: 1077),<br>SPSSNRIRNT**DLIEAIRRASNGETLEKITNSRPPCV**SPSSNRIRNT (SEQ ID NO: 1078) |
| | amino acids 23-32 of CDK4 | **DLIEAIRRASNGETLEKITNSRPPCV**ARDPHSGHFV (SEQ ID NO: 1079),<br>ARDPHSGHFV**DLIEAIRRASNGETLEKITNSRPPCV**ARDPHSGHFV (SEQ ID NO: 1080) |
| | amino acids 29-37 of β-catenin | **DLIEAIRRASNGETLEKITNSRPPCV**SYLDSGIHS (SEQ ID NO: 1081),<br>SYLDSGIHS**DLIEAIRRASNGETLEKITNSRPPCV**SYLDSGIHS (SEQ ID NO: 1082) |
| | amino acids 1-9 of tyrosinase | **DLIEAIRRASNGETLEKITNSRPPCV**MLLAVLYCL (SEQ ID NO: 1083),<br>MLLAVLYCL**DLIEAIRRASNGETLEKITNSRPPCV**MLLAVLYCL (SEQ ID NO: 1084) |
| | amino acids 206-214 of tyrosinase | **DLIEAIRRASNGETLEKITNSRPPCV**AFLPWHRLF (SEQ ID NO: 1085),<br>AFLPWHRLF**DLIEAIRRASNGETLEKITNSRPPCV**AFLPWHRLF (SEQ ID NO: 1086) |
| | amino acids 56-70 of tyrosinase | **DLIEAIRRASNGETLEKITNSRPPCV**QNILLSNAPLGPQFP (SEQ ID NO: 1087),<br>QNILLSNAPLGPQFP**DLIEAIRRASNGETLEKITNSRPPCV**QNILLSNAPLGPQFP (SEQ ID NO: 1088) |
| | amino acids 448-462 of tyrosinase | **DLIEAIRRASNGETLEKITNSRPPCV**DYSYLQDSDPDSFQD (SEQ ID NO: 1089),<br>DYSYLQDSDPDSFQD**DLIEAIRRASNGETLEKITNSRPPCV**DYSYLQDSDPDSFQD (SEQ ID NO: 1090) |
| | amino acids 32-40 of Melan-A$^{MART-1}$ | **DLIEAIRRASNGETLEKITNSRPPCV**JLTVILGVL (SEQ ID NO: 1091),<br>JLTVILGVL**DLIEAIRRASNGETLEKITNSRPPCV**JLTVILGVL (SEQ ID NO: 1092) |
| | amino acids 154-162 of gp100$^{Pmel17}$ | **DLIEAIRRASNGETLEKITNSRPPCV**KTWGQYWQV (SEQ ID NO: 1093),<br>KTWGQYWQV**DLIEAIRRASNGETLEKITNSRPPCV**KTWGQYWQV (SEQ ID NO: 1094) |
| | amino acids 209-217 of gp100$^{Pmel17}$ | **DLIEAIRRASNGETLEKITNSRPPCV**ITDQVPFSV (SEQ ID NO: 1095),<br>ITDQVPFSV**DLIEAIRRASNGETLEKITNSRPPCV**ITDQVPFSV (SEQ ID NO: 1096) |
| | amino acids 280-288 of gp100$^{Pmel17}$ | **DLIEAIRRASNGETLEKITNSRPPCV**YLEPGPVTA (SEQ ID NO: 1097),<br>YLEPGPVTA**DLIEAIRRASNGETLEKITNSRPPCV**YLEPGPVTA (SEQ ID NO: 1098) |
| | amino acids 457-466 of gp100$^{Pmel17}$ | **DLIEAIRRASNGETLEKITNSRPPCV**LLDGTATLRL (SEQ ID NO: 1099),<br>LLDGTATLRL**DLIEAIRRASNGETLEKITNSRPPCV**LLDGTATLRL (SEQ ID NO: 1100) |
| | amino acids 476-485 of gp100$^{Pmel17}$ | **DLIEAIRRASNGETLEKITNSRPPCV**VLYRYGSFSV (SEQ ID NO: 1101),<br>VLYRYGSFSV**DLIEAIRRASNGETLEKITNSRPPCV**VLYRYGSFSV (SEQ ID NO: 1102) |
| | amino acids 301-309 of PRAME | **DLIEAIRRASNGETLEKITNSRPPCV**LYVDSLFFL (SEQ ID NO: 1103),<br>LYVDSLFFL**DLIEAIRRASNGETLEKITNSRPPCV**LYVDSLFFL (SEQ ID NO: 1104) |
| | amino acids 292-303 of MAGE-6 | **DLIEAIRRASNGETLEKITNSRPPCV**KISGGPRISYPL (SEQ ID NO: 1105),<br>KISGGPRISYPL**DLIEAIRRASNGETLEKITNSRPPCV**KISGGPRISYPL (SEQ ID NO: 1106) |
| | amino acids 157-167 of NY-ESO-1 | **DLIEAIRRASNGETLEKITNSRPPCV**SLLMWITQCFL (SEQ ID NO: 1107),<br>SLLMWITQCFL**DLIEAIRRASNGETLEKITNSRPPCV**SLLMWITQCFL (SEQ ID NO: 1108) |

TABLE B-continued

| C35 Peptide/Epitope | Exemplary Tumor Rejection Peptide | Exemplary Polytopes |
|---|---|---|
| | amino acids 157-165 of NY-ESO-1 | **DLIEAIRRASNGETLEKITNSRPPCV**SLLMWITQC (SEQ ID NO: 1109),<br>SLLMWITQC**DLIEAIRRASNGETLEKITNSRPPCV**SLLMWITQC (SEQ ID NO: 1110) |
| | amino acids 155-163 of NY-ESO-1 | **DLIEAIRRASNGETLEKITNSRPPCV**QLSLLMWIT (SEQ ID NO: 1111),<br>QLSLLMWIT**DLIEAIRRASNGETLEKITNSRPPCV**QLSLLMWIT (SEQ ID NO: 1112) |
| | amino acids 157-170 of NY-ESO-1 and amino acids 281-295 of MAGE-3 | SLLMWITQCFLPVF**DLIEAIRRASNGETLEKITNSRPPCV**TSYVKVLHHMVKISG (SEQ ID NO: 1113) |
| P84-V113 of SEQ ID NO: 2 PYEKDLIEAIRRASNGETLE KITNSRPPCV | amino acids 161-169 of MAGE-1 | **PYEKDLIEAIRRASNGETLEKITNSRPPCV**EADPTGHSY (SEQ ID NO: 1114),<br>EADPTGHSY**PYEKDLIEAIRRASNGETLEKITNSRPPCV**EADPTGHSY (SEQ ID NO: 1115) |
| | amino acids 230-238 of MAGE-1 | **PYEKDLIEAIRRASNGETLEKITNSRPPCV**SAYGEPRKL (SEQ ID NO: 1116),<br>SAYGEPRKL**PYEKDLIEAIRRASNGETLEKITNSRPPCV**SAYGEPRKL (SEQ ID NO: 1117) |
| | amino acids 168-176 of MAGE-3 | **PYEKDLIEAIRRASNGETLEKITNSRPPCV**EVDPIGHLY (SEQ ID NO: 1118),<br>EVDPIGHLY**PYEKDLIEAIRRASNGETLEKITNSRPPCV**EVDPIGHLY (SEQ ID NO: 1119) |
| | amino acids 271-279 of MAGE-3 | **PYEKDLIEAIRRASNGETLEKITNSRPPCV**FLWGPRALV (SEQ ID NO: 1120),<br>FLWGPRALV**PYEKDLIEAIRRASNGETLEKITNSRPPCV**FLWGPRALV (SEQ ID NO: 1121) |
| | amino acids 167-176 of MAGE-3 | **PYEKDLIEAIRRASNGETLEKITNSRPPCV**MEVDPIGHLY (SEQ ID NO: 1122),<br>MEVDPIGHLY**PYEKDLIEAIRRASNGETLEKITNSRPPCV**MEVDPIGHLY (SEQ ID NO: 1123) |
| | amino acids 2-10 of BAGE | **PYEKDLIEAIRRASNGETLEKITNSRPPCV**AARAVFLAL (SEQ ID NO: 1124),<br>AARAVFLAL**PYEKDLIEAIRRASNGETLEKITNSRPPCV**AARAVFLAL (SEQ ID NO: 1125) |
| | amino acids 9-16 of GAGE-1,2 | **PYEKDLIEAIRRASNGETLEKITNSRPPCV**YRPRPRRY (SEQ ID NO: 1126),<br>YRPRPRRY**PYEKDLIEAIRRASNGETLEKITNSRPPCV**YRPRPRRY (SEQ ID NO: 1127) |
| | amino acids 11-20 of RAGE | **PYEKDLIEAIRRASNGETLEKITNSRPPCV**SPSSNRIRNT (SEQ ID NO: 1128),<br>SPSSNRIRNT**PYEKDLIEAIRRASNGETLEKITNSRPPCV**SPSSNRIRNT (SEQ ID NO: 1129) |
| | amino acids 23-32 of CDK4 | **PYEKDLIEAIRRASNGETLEKITNSRPPCV**ARDPHSGHFV (SEQ ID NO: 1130),<br>ARDPHSGHFV**PYEKDLIEAIRRASNGETLEKITNSRPPCV** ARDPHSGHFV (SEQ ID NO: 1131) |
| | amino acids 29-37 of β-catenin | **PYEKDLIEAIRRASNGETLEKITNSRPPCV**SYLDSGIHS (SEQ ID NO: 1132),<br>SYLDSGIHS**PYEKDLIEAIRRASNGETLEKITNSRPPCV**SYLDSGIHS (SEQ ID NO: 1133) |
| | amino acids 1-9 of tyrosinase | **PYEKDLIEAIRRASNGETLEKITNSRPPCV**MLLAVLYCL (SEQ ID NO: 1134),<br>MLLAVLYCL**PYEKDLIEAIRRASNGETLEKITNSRPPCV**MLLAVLYCL (SEQ ID NO: 1135) |
| | amino acids 206-214 of tyrosinase | **PYEKDLIEAIRRASNGETLEKITNSRPPCV**AFLPWHRLF (SEQ ID NO: 1136),<br>AFLPWHRLF**PYEKDLIEAIRRASNGETLEKITNSRPPCV**AFLPWHRLF (SEQ ID NO: 1137) |
| | amino acids 56-70 of tyrosinase | **PYEKDLIEAIRRASNGETLEKITNSRPPCV**QNILLSNAPLGPQFP (SEQ ID NO: 1138),<br>QNILLSNAPLGPQFP**PYEKDLIEAIRRASNGETLEKITNSRPPCV**QNILLSNAPLGPQFP (SEQ ID NO: 1139) |

TABLE B-continued

| C35 Peptide/Epitope | Exemplary Tumor Rejection Peptide | Exemplary Polytopes |
|---|---|---|
| | amino acids 448-462 of tyrosinase | **PYEKDLIEAIRRASNGETLEKITNSRPPCV**DYSYLQDSDPDSFQD (SEQ ID NO: 1140), DYSYLQDSDPDSFQD**PYEKDLIEAIRRASNGETLEKITNSRPPCV**DYSYLQDSDPDSFQD (SEQ ID NO: 1141) |
| | amino acids 32-40 of Melan-A$^{MART-1}$ | **PYEKDLIEAIRRASNGETLEKITNSRPPCV**JLTVILGVL (SEQ ID NO: 1142), JLTVILGVL**PYEKDLIEAIRRASNGETLEKITNSRPPCV**JLTVILGVL (SEQ ID NO: 1143) |
| | amino acids 154-162 of gp100$^{Pme117}$ | **PYEKDLIEAIRRASNGETLEKITNSRPPCV**KTWGQYWQV (SEQ ID NO: 1144), KTWGQYWQV**PYEKDLIEAIRRASNGETLEKITNSRPPCV**KTWGQYWQV (SEQ ID NO: 1145) |
| | amino acids 209-217 of gp100$^{Pme117}$ | **PYEKDLIEAIRRASNGETLEKITNSRPPCV**ITDQVPFSV (SEQ ID NO: 1146), ITDQVPFSV**PYEKDLIEAIRRASNGETLEKITNSRPPCV**ITDQVPFSV (SEQ ID NO: 1147) |
| | amino acids 280-288 of gp100$^{Pme117}$ | **PYEKDLIEAIRRASNGETLEKITNSRPPCV**YLEPGPVTA (SEQ ID NO: 1148), YLEPGPVTA**PYEKDLIEAIRRASNGETLEKITNSRPPCV**YLEPGPVTA (SEQ ID NO: 1149) |
| | amino acids 457-466 of gp100$^{Pme117}$ | **PYEKDLIEAIRRASNGETLEKITNSRPPCV**LLDGTATLRL (SEQ ID NO: 1150), LLDGTATLRL**PYEKDLIEAIRRASNGETLEKITNSRPPCV**LLDGTATLRL (SEQ ID NO: 1151) |
| | amino acids 476-485 of gp100$^{Pme117}$ | **PYEKDLIEAIRRASNGETLEKITNSRPPCV**VLYRYGSFSV (SEQ ID NO: 1152), VLYRYGSFSV**PYEKDLIEAIRRASNGETLEKITNSRPPCV**VLYRYGSFSV (SEQ ID NO: 1153) |
| | amino acids 301-309 of PRAME | **PYEKDLIEAIRRASNGETLEKITNSRPPCV**LYVDSLFFL (SEQ ID NO: 1154), LYVDSLFFL**PYEKDLIEAIRRASNGETLEKITNSRPPCV**LYVDSLFFL (SEQ ID NO: 1155) |
| | amino acids 292-303 of MAGE-6 | **PYEKDLIEAIRRASNGETLEKITNSRPPCV**KISGGPRISYPL (SEQ ID NO: 1156), KISGGPRISYPL**PYEKDLIEAIRRASNGETLEKITNSRPPCV**KISGGPRISYPL (SEQ ID NO: 1157) |
| | amino acids 157-167 of NY-ESO-1 | **PYEKDLIEAIRRASNGETLEKITNSRPPCV**SLLMWITQCFL (SEQ ID NO: 1158), SLLMWITQCFL**PYEKDLIEAIRRASNGETLEKITNSRPPCV**SLLMWITQCFL (SEQ ID NO: 1159) |
| | amino acids 157-165 of NY-ESO-1 | **PYEKDLIEAIRRASNGETLEKITNSRPPCV**SLLMWITQC (SEQ ID NO: 1160), SLLMWITQC**PYEKDLIEAIRRASNGETLEKITNSRPPCV**SLLMWITQC (SEQ ID NO: 1161) |
| | amino acids 155-163 of NY-ESO-1 | **PYEKDLIEAIRRASNGETLEKITNSRPPCV**QLSLLMWIT (SEQ ID NO: 1162), QLSLLMWIT**PYEKDLIEAIRRASNGETLEKITNSRPPCV**QLSLLMWIT (SEQ ID NO: 1163) |
| | amino acids 157-170 of NY-ESO-1 and amino acids 281-295 of MAGE-3 | SLLMWITQCFLPVF**PYEKDLIEAIRRASNGETLEKITNSRPPCV**TSYVKVLHHMVKISG (SEQ ID NO: 1164) |
| K77-V113 of SEQ ID NO: 2 KLENGGFPYEKDLIEAIRR ASNGETLEKITNSRPPCV | amino acids 161-169 of MAGE-1 | **KLENGGFPYEKDLIEAIRRASNGETLEKITNSRPPCV** EADPTGHSY (SEQ ID NO: 1165), EADPTGHSY**KLENGGFPYEKDLIEAIRRASNGETLEKITNSRPPCV** EADPTGHSY (SEQ ID NO: 1166) |
| | amino acids 230-238 of MAGE-1 | **KLENGGFPYEKDLIEAIRRASNGETLEKITNSRPPCV**SAYGEPRKL (SEQ ID NO: 1167), SAYGEPRKL**KLENGGFPYEKDLIEAIRRASNGETLEKITNSRPPCV**SAYGEPRKL (SEQ ID NO: 1168) |
| | amino acids 168-176 of MAGE-3 | **KLENGGFPYEKDLIEAIRRASNGETLEKITNSRPPCV**EVDPIGHLY (SEQ ID NO: 1169), EVDPIGHLY**KLENGGFPYEKDLIEAIRRASNGETLEKITNSRPPCV**EVDPIGHLY (SEQ ID NO: 1170) |
| | amino acids 271-279 of MAGE-3 | **KLENGGFPYEKDLIEAIRRASNGETLEKITNSRPPCV**FLWGPRALV (SEQ ID NO: 1171), FLWGPRALV**KLENGGFPYEKDLIEAIRRASNGETLEKITNSRPPCV**FLWGPRALV (SEQ ID NO: 1172) |

TABLE B-continued

| C35 Peptide/Epitope | Exemplary Tumor Rejection Peptide | Exemplary Polytopes |
|---|---|---|
| | amino acids 167-176 of MAGE-3 | **KLENGGFPYEKDLIEAIRRASNGETLEKITNSRPPCV**MEVDPIGHLY (SEQ ID NO: 1173), MEVDPIGHLY**KLENGGFPYEKDLIEAIRRASNGETLEKITNSRPPCV**MEVDPIGHLY (SEQ ID NO: 1174) |
| | amino acids 2-10 of BAGE | **KLENGGFPYEKDLIEAIRRASNGETLEKITNSRPPCV**AARAVFLAL (SEQ ID NO: 1175), AARAVFLAL**KLENGGFPYEKDLIEAIRRASNGETLEKITNSRPPCV**AARAVFLAL (SEQ ID NO: 1176) |
| | amino acids 9-16 of GAGE-1,2 | **KLENGGFPYEKDLIEAIRRASNGETLEKITNSRPPCV**YRPRPRRY (SEQ ID NO: 1177), YRPRPRRY**KLENGGFPYEKDLIEAIRRASNGETLEKITNSRPPCV**YRPRPRRY (SEQ ID NO: 1178) |
| | amino acids 11-20 of RAGE | **KLENGGFPYEKDLIEAIRRASNGETLEKITNSRPPCV**SPSSNRIRNT (SEQ ID NO: 1179), SPSSNRIRNT**KLENGGFPYEKDLIEAIRRASNGETLEKITNSRPPCV**SPSSNRIRNT (SEQ ID NO: 1180) |
| | amino acids 23-32 of CDK4 | **KLENGGFPYEKDLIEAIRRASNGETLEKITNSRPPCV**ARDPHSGHFV (SEQ ID NO: 1181), ARDPHSGHFV**KLENGGFPYEKDLIEAIRRASNGETLEKITNSRPPCV**ARDPHSGHFV (SEQ ID NO: 1182 |
| | amino acids 29-37 of β-catenin | **KLENGGFPYEKDLIEAIRRASNGETLEKITNSRPPCV**SYLDSGIHS (SEQ ID NO: 1183, SYLDSGIHS**KLENGGFPYEKDLIEAIRRASNGETLEKITNSRPPCV**SYLDSGIHS (SEQ ID NO: 1184) |
| | amino acids 1-9 of tyrosinase | **KLENGGFPYEKDLIEAIRRASNGETLEKITNSRPPCV**MLLAVLYCL (SEQ ID NO: 1185), MLLAVLYCL**KLENGGFPYEKDLIEAIRRASNGETLEKITNSRPPCV**MLLAVLYCL (SEQ ID NO: 1186) |
| | amino acids 206-214 of tyrosinase | **KLENGGFPYEKDLIEAIRRASNGETLEKITNSRPPCV**AFLPWHRLF (SEQ ID NO: 1187), AFLPWHRLF**KLENGGFPYEKDLIEAIRRASNGETLEKITNSRPPCV**AFLPWHRLF (SEQ ID NO: 1188) |
| | amino acids 56-70 of tyrosinase | **KLENGGFPYEKDLIEAIRRASNGETLEKITNSRPPCV**QNILLSNAPLGPQFP (SEQ ID NO: 1189, QNILLSNAPLGPQFP**KLENGGFPYEKDLIEAIRRASNGETLEKITNSRPPCV**QNILLSNAPL GPQFP (SEQ ID NO: 1190) |
| | amino acids 448-462 of tyrosinase | **KLENGGFPYEKDLIEAIRRASNGETLEKITNSRPPCV**DYSYLQDSDPDSFQD (SEQ ID NO: 1191), DYSYLQDSDPDSFQD**KLENGGFPYEKDLIEAIRRASNGETLEKITNSRPPCV**DYSYLQDS DPDSFQD (SEQ ID NO: 1192) |
| | amino acids 32-40 of Melan-A$^{MART-1}$ | **KLENGGFPYEKDLIEAIRRASNGETLEKITNSRPPCV**JLTVILGVL (SEQ ID NO: 1193), JLTVILGVL**KLENGGFPYEKDLIEAIRRASNGETLEKITNSRPPCV**JLTVILGVL (SEQ ID NO: 1194 |
| | amino acids 154-162 of gp100$^{Pmel17}$ | **KLENGGFPYEKDLIEAIRRASNGETLEKITNSRPPCV**KTWGQYWQV (SEQ ID NO: 1195), KTWGQYWQV**KLENGGFPYEKDLIEAIRRASNGETLEKITNSRPPCV**KTWGQYWQV (SEQ ID NO: 1196) |
| | amino acids 209-217 of gp100$^{Pmel17}$ | **KLENGGFPYEKDLIEAIRRASNGETLEKITNSRPPCV**ILITDQVPFSV (SEQ ID NO: 1197), ITDQVPFSV**KLENGGFPYEKDLIEAIRRASNGETLEKITNSRPPCV**ILITDQVPFSV (SEQ ID NO: 1198) |
| | amino acids 280-288 of gp100$^{Pmel17}$ | **KLENGGFPYEKDLIEAIRRASNGETLEKITNSRPPCV**YLEPGPVTA (SEQ ID NO: 1199), YLEPGPVTA**KLENGGFPYEKDLIEAIRRASNGETLEKITNSRPPCV**YLEPGPVTA (SEQ ID NO: 1200) |
| | amino acids 457-466 of gp100$^{Pmel17}$ | **KLENGGFPYEKDLIEAIRRASNGETLEKITNSRPPCV**LLDGTATLRL (SEQ ID NO: 1201), LLDGTATLRL**KLENGGFPYEKDLIEAIRRASNGETLEKITNSRPPCV**LLDGTATLRL (SEQ ID NO: 1202) |
| | amino acids 476-485 of gp100$^{Pmel17}$ | **KLENGGFPYEKDLIEAIRRASNGETLEKITNSRPPCV**VLYRYGSFSV (SEQ ID NO: 1203), VLYRYGSFSV**KLENGGFPYEKDLIEAIRRASNGETLEKITNSRPPCV**VLYRYGSFSV (SEQ ID NO: 1204) |

TABLE B-continued

| C35 Peptide/Epitope | Exemplary Tumor Rejection Peptide | Exemplary Polytopes |
|---|---|---|
| | amino acids 301-309 of PRAME | **KLENGGFPYEKDLIEAIRRASNGETLEKITNSRPPCV**LYVDSLFFL (SEQ ID NO: 1205), LYVDSLFFL**KLENGGFPYEKDLIEAIRRASNGETLEKITNSRPPCV**LYVDSLFFL (SEQ ID NO: 1206) |
| | amino acids 292-303 of MAGE-6 | **KLENGGFPYEKDLIEAIRRASNGETLEKITNSRPPCV**KISGGPRISYPL (SEQ ID NO: 1207), KISGGPRISYPL**KLENGGFPYEKDLIEAIRRASNGETLEKITNSRPPCV**KISGGPRISYPL (SEQ ID NO: 1208) |
| | amino acids 157-167 of NY-ESO-1 | **KLENGGFPYEKDLIEAIRRASNGETLEKITNSRPPCV**SLLMWITQCFL (SEQ ID NO: 1209), SLLMWITQCFL**KLENGGFPYEKDLIEAIRRASNGETLEKITNSRPPCV**SLLMWITQCFL (SEQ ID NO: 1210) |
| | amino acids 157-165 of NY-ESO-1 | **KLENGGFPYEKDLIEAIRRASNGETLEKITNSRPPCV**SLLMWITQC (SEQ ID NO: 1211), SLLMWITQC**KLENGGFPYEKDLIEAIRRASNGETLEKITNSRPPCV**SLLMWITQC (SEQ ID NO: 1212) |
| | amino acids 155-163 of NY-ESO-1 | **KLENGGFPYEKDLIEAIRRASNGETLEKITNSRPPCV**QLSLLMWIT (SEQ ID NO: 1213), QLSLLMWIT**KLENGGFPYEKDLIEAIRRASNGETLEKITNSRPPCV**QLSLLMWIT (SEQ ID NO: 1214 |
| | amino acids 157-170 of NY-ESO-1 and amino acids 281-295 of MAGE-3 | SLLMWITQCFLPVF**KLENGGFPYEKDLIEAIRRASNGETLEKITNSRPPCV**TSYVKVLHH MVKISG (SEQ ID NO: 1215) |
| Q72-V113 of SEQ ID NO: 2 QLVFSKLENGGFPYEKDLI EAIRRASNGETLEKITNSRP PCV | amino acids 161-169 of MAGE-1 | **QLVFSKLENGGFPYEKDLIEAIRRASNGETLEKITNSRPPCV**EADPTGHSY (SEQ ID NO: 1216), EADPTGHSY**QLVFSKLENGGFPYEKDLIEAIRRASNGETLEKITNSRPPCV**EADPTGHSY (SEQ ID NO: 1217) |
| | amino acids 230-238 of MAGE-1 | **QLVFSKLENGGFPYEKDLIEAIRRASNGETLEKITNSRPPCV**SAYGEPRKL (SEQ ID NO: 1218), SAYGEPRKL**QLVFSKLENGGFPYEKDLIEAIRRASNGETLEKITNSRPPCV**SAYGEPRKL (SEQ ID NO: 1219) |
| | amino acids 168-176 of MAGE-3 | **QLVFSKLENGGFPYEKDLIEAIRRASNGETLEKITNSRPPCV**EVDPIGHLY (SEQ ID NO: 1220), EVDPIGHLY**QLVFSKLENGGFPYEKDLIEAIRRASNGETLEKITNSRPPCV**EVDPIGHLY (SEQ ID NO: 1221) |
| | amino acids 271-279 of MAGE-3 | **QLVFSKLENGGFPYEKDLIEAIRRASNGETLEKITNSRPPCV**FLWGPRALV (SEQ ID NO: 1222) FLWGPRALV**QLVFSKLENGGFPYEKDLIEAIRRASNGETLEKITNSRPPCV**FLWGPRALV (SEQ ID NO: 1223) |
| | amino acids 167-176 of MAGE-3 | **QLVFSKLENGGFPYEKDLIEAIRRASNGETLEKITNSRPPCV**MEVDPIGHLY (SEQ ID NO: 1224), MEVDPIGHLY**QLVFSKLENGGFPYEKDLIEAIRRASNGETLEKITNSRPPCV**MEVDPIGH LY (SEQ ID NO: 1225) |
| | amino acids 2-10 of BAGE | **QLVFSKLENGGFPYEKDLIEAIRRASNGETLEKITNSRPPCV**AARAVFLAL (SEQ ID NO: 1226), AARAVFLAL**QLVFSKLENGGFPYEKDLIEAIRRASNGETLEKITNSRPPCV**AARAVFLAL (SEQ ID NO: 1227) |
| | amino acids 9-16 of GAGE-1,2 | **QLVFSKLENGGFPYEKDLIEAIRRASNGETLEKITNSRPPCV**YRPRPRRY (SEQ ID NO: 1228), YRPRPRRY**QLVFSKLENGGFPYEKDLIEAIRRASNGETLEKITNSRPPCV**YRPRPRRY (SEQ ID NO: 1229) |
| | amino acids 11-20 of RAGE | **QLVFSKLENGGFPYEKDLIEAIRRASNGETLEKITNSRPPCV**SPSSNRIRNT (SEQ ID NO: 1230), SPSSNRIRNT**QLVFSKLENGGFPYEKDLIEAIRRASNGETLEKITNSRPPCV**SPSSNRIRNT (SEQ ID NO: 1231) |
| | amino acids 23-32 of CDK4 | **QLVFSKLENGGFPYEKDLIEAIRRASNGETLEKITNSRPPCV**ARDPHSGHFV (SEQ ID NO: 1232), ARDPHSGHFV**QLVFSKLENGGFPYEKDLIEAIRRASNGETLEKITNSRPPCV**ARDPHSGH FV (SEQ ID NO: 1233) |
| | amino acids 29-37 of β-catenin | **QLVFSKLENGGFPYEKDLIEAIRRASNGETLEKITNSRPPCV**SYLDSGIHS (SEQ ID NO: 1234), SYLDSGIHS**QLVFSKLENGGFPYEKDLIEAIRRASNGETLEKITNSRPPCV**SYLDSGIHS (SEQ ID NO: 1235) |

TABLE B-continued

| C35 Peptide/Epitope | Exemplary Tumor Rejection Peptide | Exemplary Polytopes |
|---|---|---|
| | amino acids 1-9 of tyrosinase | **QLVFSKLENGGFPYEKDLIEAIRRASNGETLEKITNSRPPCV**MLLAVLYCL (SEQ ID NO: 1236), MLLAVLYCL**QLVFSKLENGGFPYEKDLIEAIRRASNGETLEKITNSRPPCV**MLLAVLYCL (SEQ ID NO: 1237) |
| | amino acids 206-214 of tyrosinase | **QLVFSKLENGGFPYEKDLIEAIRRASNGETLEKITNSRPPCV**AFLPWHRLF (SEQ ID NO: 1238), AFLPWHRLF**QLVFSKLENGGFPYEKDLIEAIRRASNGETLEKITNSRPPCV**AFLPWHRLF (SEQ ID NO: 1239) |
| | amino acids 56-70 of tyrosinase | **QLVFSKLENGGFPYEKDLIEAIRRASNGETLEKITNSRPPCV**QNILLSNAPLGPQFP (SEQ ID NO: 1240), QNILLSNAPLGPQFP**QLVFSKLENGGFPYEKDLIEAIRRASNGETLEKITNSRPPCV**QNILLSNAPLGPQFP (SEQ ID NO: 1241) |
| | amino acids 448-462 of tyrosinase | **QLVFSKLENGGFPYEKDLIEAIRRASNGETLEKITNSRPPCV**DYSYLQDSDPDSFQD (SEQ ID NO: 1242), DYSYLQDSDPDSFQD**QLVFSKLENGGFPYEKDLIEAIRRASNGETLEKITNSRPPCV**DYSYLQDSDPDSFQD (SEQ ID NO: 1243) |
| | amino acids 32-40 of Melan-A$^{MART-1}$ | **QLVFSKLENGGFPYEKDLIEAIRRASNGETLEKITNSRPPCV**JLTVILGVL (SEQ ID NO: 1244), JLTVILGVL**QLVFSKLENGGFPYEKDLIEAIRRASNGETLEKITNSRPPCV**JLTVILGVL (SEQ ID NO: 1245) |
| | amino acids 154-162 of gp100$^{Pmel17}$ | **QLVFSKLENGGFPYEKDLIEAIRRASNGETLEKITNSRPPCV**KTWGQYWQV (SEQ ID NO: 1246), KTWGQYWQV**QLVFSKLENGGFPYEKDLIEAIRRASNGETLEKITNSRPPCV**KTWGQYWQV (SEQ ID NO: 1247) |
| | amino acids 209-217 of gp100$^{Pmel17}$ | **QLVFSKLENGGFPYEKDLIEAIRRASNGETLEKITNSRPPCV**ITDQVPFSV (SEQ ID NO: 1248), ITDQVPFSV**QLVFSKLENGGFPYEKDLIEAIRRASNGETLEKITNSRPPCV**ITDQVPFSV (SEQ ID NO: 1249) |
| | amino acids 280-288 of gp100$^{Pmel17}$ | **QLVFSKLENGGFPYEKDLIEAIRRASNGETLEKITNSRPPCV**YLEPGPVTA (SEQ ID NO: 1250), YLEPGPVTA**QLVFSKLENGGFPYEKDLIEAIRRASNGETLEKITNSRPPCV**YLEPGPVTA (SEQ ID NO: 1251) |
| | amino acids 457-466 of gp100$^{Pmel17}$ | **QLVFSKLENGGFPYEKDLIEAIRRASNGETLEKITNSRPPCV**LLDGTATLRL (SEQ ID NO: 1252), LLDGTATLRL**QLVFSKLENGGFPYEKDLIEAIRRASNGETLEKITNSRPPCV**LLDGTATLRL (SEQ ID NO: 1253) |
| | amino acids 476-485 of gp100$^{Pmel17}$ | **QLVFSKLENGGFPYEKDLIEAIRRASNGETLEKITNSRPPCV**VLYRYGSFSV (SEQ ID NO: 1254), VLYRYGSFSV**QLVFSKLENGGFPYEKDLIEAIRRASNGETLEKITNSRPPCV**VLYRYGSFSV (SEQ ID NO: 1255) |
| | amino acids 301-309 of PRAME | **QLVFSKLENGGFPYEKDLIEAIRRASNGETLEKITNSRPPCV**LYVDSLFFL (SEQ ID NO: 1256), LYVDSLFFL**QLVFSKLENGGFPYEKDLIEAIRRASNGETLEKITNSRPPCV**LYVDSLFFL (SEQ ID NO: 1257) |
| | amino acids 292-303 of MAGE-6 | **QLVFSKLENGGFPYEKDLIEAIRRASNGETLEKITNSRPPCV**KISGGPRISYPL (SEQ ID NO: 1258), KISGGPRISYPL**QLVFSKLENGGFPYEKDLIEAIRRASNGETLEKITNSRPPCV**KISGGPRISYPL (SEQ ID NO: 1259) |
| | amino acids 157-167 of NY-ESO-1 | **QLVFSKLENGGFPYEKDLIEAIRRASNGETLEKITNSRPPCV**SLLMWITQCFL (SEQ ID NO: 1260), SLLMWITQCFL**QLVFSKLENGGFPYEKDLIEAIRRASNGETLEKITNSRPPCV**SLLMWITQCFL (SEQ ID NO: 1261) |
| | amino acids 157-165 of NY-ESO-1 | **QLVFSKLENGGFPYEKDLIEAIRRASNGETLEKITNSRPPCV**SLLMWITQC (SEQ ID NO: 1262), SLLMWITQC**QLVFSKLENGGFPYEKDLIEAIRRASNGETLEKITNSRPPCV**SLLMWITQC (SEQ ID NO: 1263) |

TABLE B-continued

| C35 Peptide/Epitope | Exemplary Tumor Rejection Peptide | Exemplary Polytopes |
|---|---|---|
| | amino acids 155-163 of NY-ESO-1 | **QLVFSKLENGGFPYEKDLIEAIRRASNGETLEKITNSRPPCV**QLSLLMWIT (SEQ ID NO: 1264), QLSLLMWIT**QLVFSKLENGGFPYEKDLIEAIRRASNGETLEKITNSRPPCV**QLSLLMWIT (SEQ ID NO: 1265) |
| | amino acids 157-170 of NY-ESO-1 and amino acids 281-295 of MAGE-3 | SLLMWITQCFLPVF**QLVFSKLENGGFPYEKDLIEAIRRASNGETLEKITNSRPPCV**TSYVKVLHHMVKISG (SEQ ID NO: 1266) |
| F65 to V113 of SEQ ID NO: 2 FEIEINGQLVFSKLENGGFPYEKDLIEAIRRASNGETLEKITNSRPPCV | amino acids 161-169 of MAGE-1 | **FEIEINGQLVFSKLENGGFPYEKDLIEAIRRASNGETLEKITNSRPPCV**EADPTGHSY (SEQ ID NO: 1267), EADPTGHSY**FEIEINGQLVFSKLENGGFPYEKDLIEAIRRASNGETLEKITNSRPPCV**EADPTGHSY (SEQ ID NO: 1268) |
| | amino acids 230-238 of MAGE-1 | **FEIEINGQLVFSKLENGGFPYEKDLIEAIRRASNGETLEKITNSRPPCV**SAYGEPRKL (SEQ ID NO: 1269), SAYGEPRKL**FEIEINGQLVFSKLENGGFPYEKDLIEAIRRASNGETLEKITNSRPPCV**SAYGEPRKL (SEQ ID NO: 1270) |
| | amino acids 168-176 of MAGE-3 | **FEIEINGQLVFSKLENGGFPYEKDLIEAIRRASNGETLEKITNSRPPCV**EVDPIGHLY (SEQ ID NO: 1271), EVDPIGHLY**FEIEINGQLVFSKLENGGFPYEKDLIEAIRRASNGETLEKITNSRPPCV**EVDPIGHLY (SEQ ID NO: 1272) |
| | amino acids 271-279 of MAGE-3 | **FEIEINGQLVFSKLENGGFPYEKDLIEAIRRASNGETLEKITNSRPPCV**FLWGPRALV (SEQ ID NO: 1273), FLWGPRALV**FEIEINGQLVFSKLENGGFPYEKDLIEAIRRASNGETLEKITNSRPPCV**FLWGPRALV (SEQ ID NO: 1274) |
| | amino acids 167-176 of MAGE-3 | **FEIEINGQLVFSKLENGGFPYEKDLIEAIRRASNGETLEKITNSRPPCV**MEVDPIGHLY (SEQ ID NO: 1275), MEVDPIGHLY**FEIEINGQLVFSKLENGGFPYEKDLIEAIRRASNGETLEKITNSRPPCV**MEVDPIGHLY (SEQ ID NO: 1276) |
| | amino acids 2-10 of BAGE | **FEIEINGQLVFSKLENGGFPYEKDLIEAIRRASNGETLEKITNSRPPCV**AARAVFLAL (SEQ ID NO: 1277), AARAVFLAL**FEIEINGQLVFSKLENGGFPYEKDLIEAIRRASNGETLEKITNSRPPCV**AARAVFLAL (SEQ ID NO: 1278) |
| | amino acids 9-16 of GAGE-1,2 | **FEIEINGQLVFSKLENGGFPYEKDLIEAIRRASNGETLEKITNSRPPCV**YRPRPRRY (SEQ ID NO: 1279), YRPRPRRY**FEIEINGQLVFSKLENGGFPYEKDLIEAIRRASNGETLEKITNSRPPCV**YRPRPRRY (SEQ ID NO: 1280) |
| | amino acids 11-20 of RAGE | **FEIEINGQLVFSKLENGGFPYEKDLIEAIRRASNGETLEKITNSRPPCV**SPSSNRIRNT (SEQ ID NO: 1281), SPSSNRIRNT**FEIEINGQLVFSKLENGGFPYEKDLIEAIRRASNGETLEKITNSRPPCV**SPSSNRIRNT (SEQ ID NO: 1282) |
| | amino acids 23-32 of CDK4 | **FEIEINGQLVFSKLENGGFPYEKDLIEAIRRASNGETLEKITNSRPPCV**ARDPHSGHFV (SEQ ID NO: 1283), ARDPHSGHFV**FEIEINGQLVFSKLENGGFPYEKDLIEAIRRASNGETLEKITNSRPPCV**ARDPHSGHFV (SEQ ID NO: 1284) |
| | amino acids 29-37 of β-catenin | **FEIEINGQLVFSKLENGGFPYEKDLIEAIRRASNGETLEKITNSRPPCV**SYLDSGIHS (SEQ ID NO: 1285), SYLDSGIHS**FEIEINGQLVFSKLENGGFPYEKDLIEAIRRASNGETLEKITNSRPPCV**SYLDSGIHS (SEQ ID NO: 1286) |
| | amino acids 1-9 of tyrosinase | **FEIEINGQLVFSKLENGGFPYEKDLIEAIRRASNGETLEKITNSRPPCV**MLLAVLYCL (SEQ ID NO: 1287), MLLAVLYCL**FEIEINGQLVFSKLENGGFPYEKDLIEAIRRASNGETLEKITNSRPPCV**MLLAVLYCL (SEQ ID NO: 1288) |

TABLE B-continued

| C35 Peptide/Epitope | Exemplary Tumor Rejection Peptide | Exemplary Polytopes |
|---|---|---|
| | amino acids 206-214 of tyrosinase | **FEIEINGQLVFSKLENGGFPYEKDLIEAIRRASNGETLEKITNSRPPCV**AFLPWHRLF (SEQ ID NO: 1289),<br>AFLPWHRLF**FEIEINGQLVFSKLENGGFPYEKDLIEAIRRASNGETLEKITNSRPPCV**AFL<br>PWHRLF (SEQ ID NO: 1290) |
| | amino acids 56-70 of tyrosinase | **FEIEINGQLVFSKLENGGFPYEKDLIEAIRRASNGETLEKITNSRPPCV**QNILLSNAPLGPQ<br>FP (SEQ ID NO: 1291),<br>QNILLSNAPLGPQFP**FEIEINGQLVFSKLENGGFPYEKDLIEAIRRASNGETLEKITNSRPP**<br>**CV** QNILLSNAPLGPQFP (SEQ ID NO: 1292) |
| | amino acids 448-462 of tyrosinase | **FEIEINGQLVFSKLENGGFPYEKDLIEAIRRASNGETLEKITNSRPPCV**DYSYLQDSDPDS<br>FQD (SEQ ID NO: 1293),<br>DYSYLQDSDPDSFQD**FEIEINGQLVFSKLENGGFPYEKDLIEAIRRASNGETLEKITNSRP**<br>**PCV** DYSYLQDSDPDSFQD (SEQ ID NO: 1294) |
| | amino acids 32-40 of Melan-A$^{MART-1}$ | **FEIEINGQLVFSKLENGGFPYEKDLIEAIRRASNGETLEKITNSRPPCV**JLTVILGVL (SEQ ID NO: 1295),<br>JLTVILGVL**FEIEINGQLVFSKLENGGFPYEKDLIEAIRRASNGETLEKITNSRPPCV**JLTVI<br>LGVL (SEQ ID NO: 1296) |
| | amino acids 154-162 of gp100$^{Pmel17}$ | **FEIEINGQLVFSKLENGGFPYEKDLIEAIRRASNGETLEKITNSRPPCV**KTWGQYWQV (SEQ ID NO: 1297),<br>KTWGQYWQV**FEIEINGQLVFSKLENGGFPYEKDLIEAIRRASNGETLEKITNSRPPCV**KT<br>WGQYWQV (SEQ ID NO: 1298 |
| | amino acids 209-217 of gp100$^{Pmel17}$ | **FEIEINGQLVFSKLENGGFPYEKDLIEAIRRASNGETLEKITNSRPPCV**ITDQVPFSV (SEQ ID NO: 1299),<br>ITDQVPFSV**FEIEINGQLVFSKLENGGFPYEKDLIEAIRRASNGETLEKITNSRPPCV**ITDQ<br>VPFSV (SEQ ID NO: 1300) |
| | amino acids 280-288 of gp100$^{Pmel17}$ | **FEIEINGQLVFSKLENGGFPYEKDLIEAIRRASNGETLEKITNSRPPCV**YLEPGPVTA (SEQ ID NO: 1301),<br>YLEPGPVTA**FEIEINGQLVFSKLENGGFPYEKDLIEAIRRASNGETLEKITNSRPPCV**YLE<br>PGPVTA (SEQ ID NO: 1302) |
| | amino acids 457-466 of gp100$^{Pmel17}$ | **FEIEINGQLVFSKLENGGFPYEKDLIEAIRRASNGETLEKITNSRPPCV**LLDGTATLRL (SEQ ID NO: 1303),<br>LLDGTATLRL**FEIEINGQLVFSKLENGGFPYEKDLIEAIRRASNGETLEKITNSRPPCV**LL<br>DGTATLRL (SEQ ID NO: 1304) |
| | amino acids 476-485 of gp100$^{Pmel17}$ | **FEIEINGQLVFSKLENGGFPYEKDLIEAIRRASNGETLEKITNSRPPCV**VLYRYGSFSV (SEQ ID NO: 1305),<br>VLYRYGSFSV**FEIEINGQLVFSKLENGGFPYEKDLIEAIRRASNGETLEKITNSRPPCV**VL<br>YRYGSFSV (SEQ ID NO: 1306) |
| | amino acids 301-309 of PRAME | **FEIEINGQLVFSKLENGGFPYEKDLIEAIRRASNGETLEKITNSRPPCV**LYVDSLFFL (SEQ ID NO: 1307),<br>LYVDSLFFL**FEIEINGQLVFSKLENGGFPYEKDLIEAIRRASNGETLEKITNSRPPCV**LYV<br>DSLFFL (SEQ ID NO: 1308) |
| | amino acids 292-303 of MAGE-6 | **FEIEINGQLVFSKLENGGFPYEKDLIEAIRRASNGETLEKITNSRPPCV**KISGGPRISYPL (SEQ ID NO: 1309),<br>KISGGPRISYPL**FEIEINGQLVFSKLENGGFPYEKDLIEAIRRASNGETLEKITNSRPPCV**<br>KISGGPRISYPL (SEQ ID NO: 1310) |
| | amino acids 157-167 of NY-ESO-1 | **FEIEINGQLVFSKLENGGFPYEKDLIEAIRRASNGETLEKITNSRPPCV**ILSLLMWITQCFL (SEQ ID NO: 1311),<br>SLLMWITQCFL**FEIEINGQLVFSKLENGGFPYEKDLIEAIRRASNGETLEKITNSRPPCV**S<br>LLMWITQCFL (SEQ ID NO: 1312) |

TABLE B-continued

| C35 Peptide/Epitope | Exemplary Tumor Rejection Peptide | Exemplary Polytopes |
|---|---|---|
| | amino acids 157-165 of NY-ESO-1 | **FEIEINGQLVFSKLENGGFPYEKDLIEAIRRASNGETLEKITNSRPPCV**SLLMWITQC (SEQ ID NO: 1313), SLLMWITQC**FEIEINGQLVFSKLENGGFPYEKDLIEAIRRASNGETLEKITNSRPPCV**SLLMWITQC (SEQ ID NO: 1314) |
| | amino acids 155-163 of NY-ESO-1 | **FEIEINGQLVFSKLENGGFPYEKDLIEAIRRASNGETLEKITNSRPPCV**QLSLLMWIT (SEQ ID NO: 1315), QLSLLMWIT**FEIEINGQLVFSKLENGGFPYEKDLIEAIRRASNGETLEKITNSRPPCV**QLSLLMWIT (SEQ ID NO: 1316) |
| | amino acids 157-170 of NY-ESO-1 and amino acids 281-295 of MAGE-3 | SLLMWITQCFLPVF**FEIEINGQLVFSKLENGGFPYEKDLIEAIRRASNGETLEKITNSRPPCV**TSYVKVLHHMVKISG (SEQ ID NO: 1317) |
| L59-V113 of SEQ ID NO: 2 LGGTGAFEIEINGQLVFSKLENGGFPYEKDLIEAIRRASNGETLEKITNSRPPCV | amino acids 161-169 of MAGE-1 | **LGGTGAFEIEINGQLVFSKLENGGFPYEKDLIEAIRRASNGETLEKITNSRPPCV**EADPTGHSY (SEQ ID NO: 1318), EADPTGHSY**LGGTGAFEIEINGQLVFSKLENGGFPYEKDLIEAIRRASNGETLEKITNSRPPCV** EADPTGHSY (SEQ ID NO: 1319) |
| | amino acids 230-238 of MAGE-1 | **LGGTGAFEIEINGQLVFSKLENGGFPYEKDLIEAIRRASNGETLEKITNSRPPCV**SAYGEPRKL (SEQ ID NO: 1320), SAYGEPRKL**LGGTGAFEIEINGQLVFSKLENGGFPYEKDLIEAIRRASNGETLEKITNSRPPCV** SAYGEPRKL (SEQ ID NO: 1321) |
| | amino acids 168-176 of MAGE-3 | **LGGTGAFEIEINGQLVFSKLENGGFPYEKDLIEAIRRASNGETLEKITNSRPPCV**EVDPIGHLY (SEQ ID NO: 1322), EVDPIGHLY**LGGTGAFEIEINGQLVFSKLENGGFPYEKDLIEAIRRASNGETLEKITNSRPPCV** EVDPIGHLY (SEQ ID NO: 1323) |
| | amino acids 271-279 of MAGE-3 | **LGGTGAFEIEINGQLVFSKLENGGFPYEKDLIEAIRRASNGETLEKITNSRPPCV**FLWGPRALV (SEQ ID NO: 1324), FLWGPRALV**LGGTGAFEIEINGQLVFSKLENGGFPYEKDLIEAIRRASNGETLEKITNSRPPCV** FLWGPRALV (SEQ ID NO: 1325) |
| | amino acids 167-176 of MAGE-3 | **LGGTGAFEIEINGQLVFSKLENGGFPYEKDLIEAIRRASNGETLEKITNSRPPCV**MEVDPIGHLY (SEQ ID NO: 1326), MEVDPIGHLY**LGGTGAFEIEINGQLVFSKLENGGFPYEKDLIEAIRRASNGETLEKITNSRPPCV**MEVDPIGHLY (SEQ ID NO: 1327) |
| | amino acids 2-10 of BAGE | **LGGTGAFEIEINGQLVFSKLENGGFPYEKDLIEAIRRASNGETLEKITNSRPPCV**AARAVFLAL (SEQ ID NO: 1328), AARAVFLAL**LGGTGAFEIEINGQLVFSKLENGGFPYEKDLIEAIRRASNGETLEKITNSRPPCV** AARAVFLAL (SEQ ID NO: 1329) |
| | amino acids 9-16 of GAGE-1,2 | **LGGTGAFEIEINGQLVFSKLENGGFPYEKDLIEAIRRASNGETLEKITNSRPPCV**YRPRPRRY (SEQ ID NO: 1330), YRPRPRRY**LGGTGAFEIEINGQLVFSKLENGGFPYEKDLIEAIRRASNGETLEKITNSRPPCV** YRPRPRRY (SEQ ID NO: 1331) |
| | amino acids 11-20 of RAGE | **LGGTGAFEIEINGQLVFSKLENGGFPYEKDLIEAIRRASNGETLEKITNSRPPCV**SPSSNRIRNT (SEQ ID NO: 1332), SPSSNRIRNT**LGGTGAFEIEINGQLVFSKLENGGFPYEKDLIEAIRRASNGETLEKITNSRPPCV**SPSSNRIRNT (SEQ ID NO: 1333) |

TABLE B-continued

| C35 Peptide/Epitope | Exemplary Tumor Rejection Peptide | Exemplary Polytopes |
|---|---|---|
| | amino acids 23-32 of CDK4 | **LGGTGAFEIEINGQLVFSKLENGGFPYEKDLIEAIRRASNGETLEKITNSRPPCV**ARDPHSGHFV (SEQ ID NO: 1334), ARDPHSGHFV**LGGTGAFEIEINGQLVFSKLENGGFPYEKDLIEAIRRASNGETLEKITNSRPPCV**ARDPHSGHFV (SEQ ID NO: 1335) |
| | amino acids 29-37 of β-catenin | **LGGTGAFEIEINGQLVFSKLENGGFPYEKDLIEAIRRASNGETLEKITNSRPPCV**SYLDSGIHS (SEQ ID NO: 1336), SYLDSGIHS**LGGTGAFEIEINGQLVFSKLENGGFPYEKDLIEAIRRASNGETLEKITNSRPPCV**SYLDSGIHS (SEQ ID NO: 1337) |
| | amino acids 1-9 of tyrosinase | **LGGTGAFEIEINGQLVFSKLENGGFPYEKDLIEAIRRASNGETLEKITNSRPPCV**MLLAVLYCL (SEQ ID NO: 1338), MLLAVLYCL**LGGTGAFEIEINGQLVFSKLENGGFPYEKDLIEAIRRASNGETLEKITNSRPPCV** MLLAVLYCL (SEQ ID NO: 1339) |
| | amino acids 206-214 of tyrosinase | **LGGTGAFEIEINGQLVFSKLENGGFPYEKDLIEAIRRASNGETLEKITNSRPPCV**AFLPWHRLF (SEQ ID NO: 1340), AFLPWHRLF**LGGTGAFEIEINGQLVFSKLENGGFPYEKDLIEAIRRASNGETLEKITNSRPPCV** AFLPWHRLF (SEQ ID NO: 1341) |
| | amino acids 56-70 of tyrosinase | **LGGTGAFEIEINGQLVFSKLENGGFPYEKDLIEAIRRASNGETLEKITNSRPPCV**QNILLSNAPLGPQFP (SEQ ID NO: 1342), QNILLSNAPLGPQFP**LGGTGAFEIEINGQLVFSKLENGGFPYEKDLIEAIRRASNGETLEKITNSRPPCV**QNILLSNAPLGPQFP (SEQ ID NO: 1343) |
| | amino acids 448-462 of tyrosinase | LGGTGAFEIEINGQLVFSKLENGGFPYEKDLIEAIRRASNGETLEKITNSRPPCVDYSYLQDSDPDSFQD (SEQ ID NO: 1344), DYSYLQDSDPDSFQD**LGGTGAFEIEINGQLVFSKLENGGFPYEKDLIEAIRRASNGETLEKITNSRPPCV**DYSYLQDSDPDSFQD (SEQ ID NO: 1345) |
| | amino acids 32-40 of Melan-A$^{MART-1}$ | **LGGTGAFEIEINGQLVFSKLENGGFPYEKDLIEAIRRASNGETLEKITNSRPPCV**JLTVILGVL (SEQ ID NO: 1346), JLTVILGVL**LGGTGAFEIEINGQLVFSKLENGGFPYEKDLIEAIRRASNGETLEKITNSRPPCV** JLTVILGVL (SEQ ID NO: 1347) |
| | amino acids 154-162 of gp100$^{Pmel17}$ | **LGGTGAFEIEINGQLVFSKLENGGFPYEKDLIEAIRRASNGETLEKITNSRPPCV**KTWGQYWQV (SEQ ID NO: 1348), KTWGQYWQV**LGGTGAFEIEINGQLVFSKLENGGFPYEKDLIEAIRRASNGETLEKITNSRPPCV**KTWGQYWQV (SEQ ID NO: 1349) |
| | amino acids 209-217 of gp100$^{Pmel17}$ | **LGGTGAFEIEINGQLVFSKLENGGFPYEKDLIEAIRRASNGETLEKITNSRPPCV**ITDQVPFSV (SEQ ID NO: 1350), ITDQVPFSV**LGGTGAFEIEINGQLVFSKLENGGFPYEKDLIEAIRRASNGETLEKITNSRPPCV**ITDQVPFSV (SEQ ID NO: 1351) |
| | amino acids 280-288 of gp100$^{Pmel17}$ | **LGGTGAFEIEINGQLVFSKLENGGFPYEKDLIEAIRRASNGETLEKITNSRPPCV**YLEPGPVTA (SEQ ID NO: 1352), YLEPGPVTA**LGGTGAFEIEINGQLVFSKLENGGFPYEKDLIEAIRRASNGETLEKITNSRPPCV** YLEPGPVTA (SEQ ID NO: 1353) |

TABLE B-continued

| C35 Peptide/Epitope | Exemplary Tumor Rejection Peptide | Exemplary Polytopes |
|---|---|---|
| | amino acids 457-466 of gp100$^{Pmel17}$ | **LGGTGAFEIEINGQLVFSKLENGGFPYEKDLIEAIRRASNGETLEKITNSRPPCV**LLDGTATLRL (SEQ ID NO: 1354),<br>LLDGTATLRL**LGGTGAFEIEINGQLVFSKLENGGFPYEKDLIEAIRRASNGETLEKITNSRPPCV**LLDGTATLRL (SEQ ID NO: 1355) |
| | amino acids 476-485 of gp100$^{Pmel17}$ | **LGGTGAFEIEINGQLVFSKLENGGFPYEKDLIEAIRRASNGETLEKITNSRPPCV**VLYRYGSFSV (SEQ ID NO: 1356),<br>VLYRYGSFSV**LGGTGAFEIEINGQLVFSKLENGGFPYEKDLIEAIRRASNGETLEKITNSRPPCV**VLYRYGSFSV (SEQ ID NO: 1357) |
| | amino acids 301-309 of PRAME | **LGGTGAFEIEINGQLVFSKLENGGFPYEKDLIEAIRRASNGETLEKITNSRPPCV**LYVDSLFFL (SEQ ID NO: 1358),<br>LYVDSLFFL**LGGTGAFEIEINGQLVFSKLENGGFPYEKDLIEAIRRASNGETLEKITNSRPPCV** LYVDSLFFL (SEQ ID NO: 1359) |
| | amino acids 292-303 of MAGE-6 | **LGGTGAFEIEINGQLVFSKLENGGFPYEKDLIEAIRRASNGETLEKITNSRPPCV**KISGGPRISYPL (SEQ ID NO: 1360),<br>KISGGPRISYPL**LGGTGAFEIEINGQLVFSKLENGGFPYEKDLIEAIRRASNGETLEKITNSRPPCV**KISGGPRISYPL (SEQ ID NO: 1361) |
| | amino acids 157-167 of NY-ESO-1 | **LGGTGAFEIEINGQLVFSKLENGGFPYEKDLIEAIRRASNGETLEKITNSRPPCV**SLLMWITQCFL (SEQ ID NO: 1362),<br>SLLMWITQCFL**LGGTGAFEIEINGQLVFSKLENGGFPYEKDLIEAIRRASNGETLEKITNSRPPCV**SLLMWITQCFL (SEQ ID NO: 1363) |
| | amino acids 157-165 of NY-ESO-1 | **LGGTGAFEIEINGQLVFSKLENGGFPYEKDLIEAIRRASNGETLEKITNSRPPCV**SLLMWITQC (SEQ ID NO: 1364),<br>SLLMWITQC**LGGTGAFEIEINGQLVFSKLENGGFPYEKDLIEAIRRASNGETLEKITNSRPPCV** SLLMWITQC (SEQ ID NO: 1365) |
| | amino acids 155-163 of NY-ESO-1 | **LGGTGAFEIEINGQLVFSKLENGGFPYEKDLIEAIRRASNGETLEKITNSRPPCV**QLSLLMWIT (SEQ ID NO: 1366),<br>QLSLLMWIT**LGGTGAFEIEINGQLVFSKLENGGFPYEKDLIEAIRRASNGETLEKITNSRPPCV** QLSLLMWIT (SEQ ID NO: 1367) |
| | amino acids 157-170 of NY-ESO-1 and amino acids 281-295 of MAGE-3 | SLLMWITQCFLPVF**LGGTGAFEIEINGQLVFSKLENGGFPYEKDLIEAIRRASNGETLEKITNSRPPCV**TSYVKVLHHMVKISG (SEQ ID NO: 1368) |
| G99-V113 of SEQ ID NO: 2 GETLEKITNSRPPCV | amino acids 161-169 of MAGE-1 | **GETLEKITNSRPPCV**EADPTGHSY (SEQ ID NO: 1369),<br>EADPTGHSY**GETLEKITNSRPPCV**EADPTGHSY (SEQ ID NO: 1370) |
| | amino acids 230-238 of MAGE-1 | **GETLEKITNSRPPCV**SAYGEPRKL (SEQ ID NO: 1371),<br>SAYGEPRKL**GETLEKITNSRPPCV**SAYGEPRKL (SEQ ID NO: 1372) |
| | amino acids 168-176 of MAGE-3 | **GETLEKITNSRPPCV**EVDPIGHLY (SEQ ID NO: 1373),<br>EVDPIGHLY**GETLEKITNSRPPCV**EVDPIGHLY (SEQ ID NO: 1374) |
| | amino acids 271-279 of MAGE-3 | **GETLEKITNSRPPCV**FLWGPRALV (SEQ ID NO: 1375),<br>FLWGPRALV**GETLEKITNSRPPCV**FLWGPRALV (SEQ ID NO: 1376) |

TABLE B-continued

| C35 Peptide/Epitope | Exemplary Tumor Rejection Peptide | Exemplary Polytopes |
|---|---|---|
| | amino acids 167-176 of MAGE-3 | **GETLEKITNSRPPCV**MEVDPIGHLY (SEQ ID NO: 1377),<br>MEVDPIGHLY**GETLEKITNSRPPCV**MEVDPIGHLY (SEQ ID NO: 1378) |
| | amino acids 2-10 of BAGE | **GETLEKITNSRPPCV**AARAVFLAL (SEQ ID NO: 1379),<br>AARAVFLAL**GETLEKITNSRPPCV**AARAVFLAL (SEQ ID NO: 1380) |
| | amino acids 9-16 of GAGE-1,2 | **GETLEKITNSRPPCV**YRPRPRRY (SEQ ID NO: 1381),<br>YRPRPRRY**GETLEKITNSRPPCV**YRPRPRRY (SEQ ID NO: 1382) |
| | amino acids 11-20 of RAGE | **GETLEKITNSRPPCV**SPSSNRIRNT (SEQ ID NO: 1383),<br>SPSSNRIRNT**GETLEKITNSRPPCV**SPSSNRIRNT (SEQ ID NO: 1384) |
| | amino acids 23-32 of CDK4 | **GETLEKITNSRPPCV**ARDPHSGHFV (SEQ ID NO: 1385),<br>ARDPHSGHFV**GETLEKITNSRPPCV**ARDPHSGHFV (SEQ ID NO: 1386) |
| | amino acids 29-37 of β-catenin | **GETLEKITNSRPPCV**SYLDSGIHS (SEQ ID NO: 1387),<br>SYLDSGIHS**GETLEKITNSRPPCV**SYLDSGIHS (SEQ ID NO: 1388) |
| | amino acids 1-9 of Tyrosinase | **GETLEKITNSRPPCV**MLLAVLYCL (SEQ ID NO: 1389),<br>MLLAVLYCL**GETLEKITNSRPPCV**MLLAVLYCL (SEQ ID NO: 1390) |
| | amino acids 206-214 of Tyrosinase | **GETLEKITNSRPPCV**AFLPWHRLF (SEQ ID NO: 1391),<br>AFLPWHRLF**GETLEKITNSRPPCV**AFLPWHRLF (SEQ ID NO: 1392) |
| | amino acids 56-70 of Tyrosinase | **GETLEKITNSRPPCV**QNILLSNAPLGPQFP (SEQ ID NO: 1393),<br>QNILLSNAPLGPQFP**GETLEKITNSRPPCV**QNILLSNAPLGPQFP (SEQ ID NO: 1394) |
| | amino acids 448-462 of Tyrosinase | **GETLEKITNSRPPCV**DYSYLQDSDPDSFQD (SEQ ID NO: 1395),<br>DYSYLQDSDPDSFQD**GETLEKITNSRPPCV**DYSYLQDSDPDSFQD (SEQ ID NO: 1396) |
| | amino acids 32-40 of Melan-A$^{MART-1}$ | **GETLEKITNSRPPCV**JLTVILGVL (SEQ ID NO: 1397),<br>JLTVILGVL**GETLEKITNSRPPCV**JLTVILGVL (SEQ ID NO: 1398) |
| | amino acids 154-162 of gp100$^{Pme117}$ | **GETLEKITNSRPPCV**KTWGQYWQV (SEQ ID NO: 1399,<br>KTWGQYWQV**GETLEKITNSRPPCV**KTWGQYWQV (SEQ ID NO: 1400) |
| | amino acids 209-217 of gp100$^{Pme117}$ | **SVAPPPEEV**ITDQVPFSV (SEQ ID NO: 1401),<br>ITDQVPFSV**SVAPPPEEV**ITDQVPFSV (SEQ ID NO: 1402) |
| | amino acids 280-288 of gp100$^{Pme117}$ | **SVAPPPEEV**YLEPGPVTA (SEQ ID NO: 1403),<br>YLEPGPVTA**SVAPPPEEV**YLEPGPVTA (SEQ ID NO: 1404) |
| | amino acids 457-466 of gp100$^{Pme117}$ | **GETLEKITNSRPPCV**LLDGTATLRL (SEQ ID NO: 1405),<br>LLDGTATLRL**GETLEKITNSRPPCV**LLDGTATLRL (SEQ ID NO: 1406) |
| | amino acids 476-485 of gp100$^{Pme117}$ | **GETLEKITNSRPPCV**VLYRYGSFSV (SEQ ID NO: 1407),<br>VLYRYGSFSV**GETLEKITNSRPPCV**VLYRYGSFSV (SEQ ID NO: 1408) |
| | amino acids 301-309 of PRAME | **GETLEKITNSRPPCV**LYVDSLFFL (SEQ ID NO: 1409),<br>LYVDSLFFL**GETLEKITNSRPPCV**LYVDSLFFL (SEQ ID NO: 1410) |

TABLE B-continued

| C35 Peptide/Epitope | Exemplary Tumor Rejection Peptide | Exemplary Polytopes |
|---|---|---|
| | amino acids 292-303 of MAGE-6 | **GETLEKITNSRPPCV**KISGGPRISYPL (SEQ ID NO: 1411),<br>KISGGPRISYPL**GETLEKITNSRPPCV**KISGGPRISYPL (SEQ ID NO: 1412) |
| | amino acids 157-167 of NY-ESO-1 | **GETLEKITNSRPPCV**SLLMWITQCFL (SEQ ID NO: 1413),<br>SLLMWITQCFL**GETLEKITNSRPPCV**SLLMWITQCFL (SEQ ID NO: 1414) |
| | amino acids 157-165 of NY-ESO-1 | **GETLEKITNSRPPCV**SLLMWITQC (SEQ ID NO: 1415),<br>SLLMWITQC**GETLEKITNSRPPCV**SLLMWITQC (SEQ ID NO: 1416) |
| | amino acids 155-163 of NY-ESO-1 | **GETLEKITNSRPPCV**QLSLLMWIT (SEQ ID NO: 1417),<br>QLSLLMWIT**GETLEKITNSRPPCV**QLSLLMWIT (SEQ ID NO: 1418) |
| | amino acids 157-170 of NY-ESO-1 and amino acids 281-295 of MAGE-3 | SLLMWITQCFLPVF**GETLEKITNSRPPCV**TSYVKVLHHMVKISG (SEQ ID NO: 1419) |
| E100-V113 of SEQ ID NO: 2 ETLEKITNSRPPCV | amino acids 161-169 of MAGE-1 | **ETLEKITNSRPPCV**ADPTGHSY (SEQ ID NO: 1420),<br>EADPTGHSY**ETLEKITNSRPPCV**EADPTGHSY (SEQ ID NO: 1421) |
| | amino acids 230-238 of MAGE-1 | **ETLEKITNSRPPCV**SAYGEPRKL (SEQ ID NO: 1422),<br>SAYGEPRKL**ETLEKITNSRPPCV**SAYGEPRKL (SEQ ID NO: 1423) |
| | amino acids 168-176 of MAGE-3 | **ETLEKITNSRPPCV**EVDPIGHLY (SEQ ID NO: 1424),<br>EVDPIGHLY **ETLEKITNSRPPCV**EVDPIGHLY (SEQ ID NO: 1425) |
| | amino acids 271-279 of MAGE-3 | **ETLEKITNSRPPCV**FLWGPRALV (SEQ ID NO: 1426),<br>FLWGPRALV**ETLEKITNSRPPCV**FLWGPRALV (SEQ ID NO: 1427) |
| | amino acids 167-176 of MAGE-3 | **ETLEKITNSRPPCV**MEVDPIGHLY (SEQ ID NO: 1428),<br>MEVDPIGHLY**ETLEKITNSRPPCV**MEVDPIGHLY (SEQ ID NO: 1429) |
| | amino acids 2-10 of BAGE | **ETLEKITNSRPPCV**AARAVFLAL (SEQ ID NO: 1430),<br>AARAVFLAL**ETLEKITNSRPPCV**AARAVFLAL (SEQ ID NO: 1431) |
| | amino acids 9-16 of GAGE-1,2 | **ETLEKITNSRPPCV**YRPRPRRY (SEQ ID NO: 1432),<br>YRPRPRRY**ETLEKITNSRPPCV**YRPRPRRY (SEQ ID NO: 1433) |
| | amino acids 11-20 of RAGE | **ETLEKITNSRPPCV**SPSSNRIRNT (SEQ ID NO: 1434),<br>SPSSNRIRNT**ETLEKITNSRPPCV**SPSSNRIRNT (SEQ ID NO: 1435) |
| | amino acids 23-32 of CDK4 | **ETLEKITNSRPPCV**ARDPHSGHFV (SEQ ID NO: 1436,<br>ARDPHSGHFV**ETLEKITNSRPPCV**ARDPHSGHFV (SEQ ID NO: 1437) |
| | amino acids 29-37 of β-catenin | **ETLEKITNSRPPCV**SYLDSGIHS (SEQ ID NO: 1438),<br>SYLDSGIHS**ETLEKITNSRPPCV**SYLDSGIHS (SEQ ID NO: 1439) |
| | amino acids 1-9 of Tyrosinase | **ETLEKITNSRPPCV**MLLAVLYCL (SEQ ID NO: 1440),<br>MLLAVLYCL**ETLEKITNSRPPCV**MLLAVLYCL (SEQ ID NO: 1441) |
| | amino acids 206-214 of Tyrosinase | **ETLEKITNSRPPCV**AFLPWHRLF (SEQ ID NO: 1442),<br>AFLPWHRLF**ETLEKITNSRPPCV**AFLPWHRLF (SEQ ID NO: 1443) |

TABLE B-continued

| C35 Peptide/Epitope | Exemplary Tumor Rejection Peptide | Exemplary Polytopes |
|---|---|---|
| | amino acids 56-70 of Tyrosinase | **ETLEKITNSRPPCV**QNILLSNAPLGPQFP (SEQ ID NO: 1444),<br>QNILLSNAPLGPQFP**ETLEKITNSRPPCV**QNILLSNAPLGPQFP (SEQ ID NO: 1445) |
| | amino acids 448-462 of Tyrosinase | **ETLEKITNSRPPCV**DYSYLQDSDPDSFQD (SEQ ID NO: 1446),<br>DYSYLQDSDPDSFQD**ETLEKITNSRPPCV**DYSYLQDSDPDSFQD (SEQ ID NO: 1447) |
| | amino acids 32-40 of Melan-A$^{MART-1}$ | **ETLEKITNSRPPCV**JLTVILGVL (SEQ ID NO: 1448),<br>JLTVILGVL**ETLEKITNSRPPCV**JLTVILGVL (SEQ ID NO: 1449) |
| | amino acids 154-162 of gp100$^{Pmel17}$ | **ETLEKITNSRPPCV**KTWGQYWQV (SEQ ID NO: 1450),<br>KTWGQYWQV**ETLEKITNSRPPCV**KTWGQYWQV (SEQ ID NO: 1451) |
| | amino acids 209-217 of gp100$^{Pmel17}$ | **ETLEKITNSRPPCV**ITDQVPFSV (SEQ ID NO: 1452),<br>ITDQVPFSV**ETLEKITNSRPPCV**ITDQVPFSV (SEQ ID NO: 1453) |
| | amino acids 280-288 of gp100$^{Pmel17}$ | **ETLEKITNSRPPCV**YLEPGPVTA (SEQ ID NO: 1454),<br>YLEPGPVTA**ETLEKITNSRPPCV**YLEPGPVTA (SEQ ID NO: 1455) |
| | amino acids 457-466 of gp100$^{Pmel17}$ | **ETLEKITNSRPPCV**LLDGTATLRL (SEQ ID NO: 1456),<br>LLDGTATLRL**ETLEKITNSRPPCV**LLDGTATLRL (SEQ ID NO: 1457) |
| | amino acids 476-485 of gp100$^{Pmel17}$ | **ETLEKITNSRPPCV**VLYRYGSFSV (SEQ ID NO: 1458),<br>VLYRYGSFSV**ETLEKITNSRPPCV**VLYRYGSFSV (SEQ ID NO: 1459) |
| | amino acids 301-309 of PRAME | **ETLEKITNSRPPCV**LYVDSLFFL (SEQ ID NO: 1460),<br>LYVDSLFFL**ETLEKITNSRPPCV**LYVDSLFFL (SEQ ID NO: 1461) |
| | amino acids 292-303 of MAGE-6 | **ETLEKITNSRPPCV**KISGGPRISYPL (SEQ ID NO: 1462),<br>KISGGPRISYPL**ETLEKITNSRPPCV**KISGGPRISYPL (SEQ ID NO: 1463) |
| | amino acids 157-167 of NY-ESO-1 | **ETLEKITNSRPPCV**SLLMWITQCFL (SEQ ID NO: 1464),<br>SLLMWITQCFL**ETLEKITNSRPPCV**SLLMWITQCFL (SEQ ID NO: 1465) |
| | amino acids 157-165 of NY-ESO-1 | **ETLEKITNSRPPCV**SLLMWITQC (SEQ ID NO: 1466),<br>SLLMWITQC**ETLEKITNSRPPCV**SLLMWITQC (SEQ ID NO: 1467) |
| | amino acids 155-163 of NY-ESO-1 | **ETLEKITNSRPPCV**QLSLLMWIT (SEQ ID NO: 1468),<br>QLSLLMWIT**ETLEKITNSRPPCV**QLSLLMWIT (SEQ ID NO: 1469) |
| | amino acids 157-170 of NY-ESO-1 and amino acids 281-295 of MAGE-3 | SLLMWITQCFLPVF**ETLEKITNSRPPCV**TSYVKVLHHMVKISG (SEQ ID NO: 1470) |

TABLE C

| C35 Epitope Analog | Exemplary Tumor Rejection Peptide | Exemplary Polytope |
|---|---|---|
| Analog of S77-Y85 of SEQ ID NO: 2 having valine substituted for tyrosine at ninth amino acid residue (KLENGGFPV, SEQ ID NO: 171) | amino acids 161-169 of MAGE-1 | **KLENGGFPV**EADPTGHSY (SEQ ID NO: 1471), EADPTGHSY**KLENGGFPV**EADPTGHSY (SEQ ID NO: 1472) |
| | amino acids 230-238 of MAGE-1 | **KLENGGFPV**SAYGEPRKL (SEQ ID NO: 1473), SAYGEPRKL**KLENGGFPV**SAYGEPRKL (SEQ ID NO: 1474) |
| | amino acids 168-176 of MAGE-3 | **KLENGGFPV**EVDPIGHLY (SEQ ID NO: 1475), EVDPIGHLY**KLENGGFPV**EVDPIGHLY (SEQ ID NO: 1476) |
| | amino acids 271-279 of MAGE-3 | **KLENGGFPV**FLWGPRALV (SEQ ID NO: 1477), FLWGPRALV**KLENGGFPV**FLWGPRALV (SEQ ID NO: 1478) |
| | amino acids 167-176 of MAGE-3 | **KLENGGFPV**MEVDPIGHLY (SEQ ID NO: 1479), MEVDPIGHLY**KLENGGFPV**MEVDPIGHLY (SEQ ID NO: 1480) |
| | amino acids 2-10 of BAGE | **KLENGGFPV**AARAVFLAL (SEQ ID NO: 1481), AARAVFLAL**KLENGGFPV**AARAVFLAL (SEQ ID NO: 1482) |
| | amino acids 9-16 of GAGE-1,2 | **KLENGGFPV**YRPRPRRY (SEQ ID NO: 1483), YRPRPRRY**KLENGGFPV**YRPRPRRY (SEQ ID NO: 1484) |
| | amino acids 11-20 of RAGE | **KLENGGFPV**SPSSNRIRNT (SEQ ID NO: 1485), SPSSNRIRNT**KLENGGFPV**SPSSNRIRNT (SEQ ID NO: 1486) |
| | amino acids 23-32 of CDK4 | **KLENGGFPV**ARDPHSGHFV (SEQ ID NO: 1487), ARDPHSGHFV**KLENGGFPV**ARDPHSGHFV (SEQ ID NO: 1488) |
| | amino acids 29-37 of β-catenin | **KLENGGFPV**SYLDSGIHS (SEQ ID NO: 1489), SYLDSGIHS**KLENGGFPV**SYLDSGIHS (SEQ ID NO: 1490) |
| | amino acids 1-9 of Tyrosinase | **KLENGGFPV**MLLAVLYCL (SEQ ID NO: 1500), MLLAVLYCL**KLENGGFPV**MLLAVLYCL (SEQ ID NO: 1501) |
| | amino acids 206-214 of Tyrosinase | **KLENGGFPV**AFLPWHRLF (SEQ ID NO: 1502), AFLPWHRLF**KLENGGFPV**AFLPWHRLF (SEQ ID NO: 1503) |
| | amino acids 56-70 of Tyrosinase | **KLENGGFPV**QNILLSNAPLGPQFP (SEQ ID NO: 1504), QNILLSNAPLGPQFP**KLENGGFPV**QNILLSNAPLGPQFP (SEQ ID NO: 1505) |
| | amino acids 448-462 of Tyrosinase | **KLENGGFPV**DYSYLQDSDPDSFQD (SEQ ID NO: 1506), DYSYLQDSDPDSFQD**KLENGGFPV**DYSYLQDSDPDSFQD (SEQ ID NO: 1507) |
| | amino acids 32-40 of Melan-$A^{MART-1}$ | **KLENGGFPV**JLTVILGVL (SEQ ID NO: 1508), JLTVILGVL**KLENGGFPV**JLTVILGVL (SEQ ID NO: 1509) |
| | amino acids 154-162 of $gp100^{Pmel17}$ | **KLENGGFPV**KTWGQYWQV (SEQ ID NO: 1510), KTWGQYWQV**KLENGGFPV**KTWGQYWQV (SEQ ID NO: 1511) |

TABLE C-continued

| C35 Epitope Analog | Exemplary Tumor Rejection Peptide | Exemplary Polytope |
|---|---|---|
| | amino acids 209-217 of $gp100^{Pmel17}$ | **KLENGGFPV**ITDQVPFSV (SEQ ID NO: 1512), ITDQVPFSV**KLENGGFPV**ITDQVPFSV (SEQ ID NO: 1513) |
| | amino acids 280-288 of $gp100^{Pmel17}$ | **KLENGGFPV**YLEPGPVTA (SEQ ID NO: 1514), YLEPGPVTA**KLENGGFPV**YLEPGPVTA (SEQ ID NO: 1515) |
| | amino acids 457-466 of $gp100^{Pmel17}$ | **KLENGGFPV**LLDGTATLRL (SEQ ID NO: 1516), LLDGTATLRL**KLENGGFPV**LLDGTATLRL (SEQ ID NO: 1517) |
| | amino acids 476-485 of $gp100^{Pmel17}$ | **KLENGGFPV**VLYRYGSFSV (SEQ ID NO: 1518), VLYRYGSFSV**KLENGGFPV**VLYRYGSFSV (SEQ ID NO: 1519) |
| | amino acids 301-309 of PRAME | **KLENGGFPV**LYVDSLFFL (SEQ ID NO: 1520), LYVDSLFFL**KLENGGFPV**LYVDSLFFL (SEQ ID NO: 1521) |
| | amino acids 292-303 of MAGE-6 | **KLENGGFPV**KISGGPRISYPL (SEQ ID NO: 1522), KISGGPRISYPL**KLENGGFPV**KISGGPRISYPL (SEQ ID NO: 1523) |
| | amino acids 157-167 of NY-ESO-1 | **KLENGGFPV**SLLMWITQCFL (SEQ ID NO: 1524), SLLMWITQCFL**KLENGGFPV**SLLMWITQCFL (SEQ ID NO: 1525) |
| | amino acids 157-165 of NY-ESO-1 | **KLENGGFPV**SLLMWITQC (SEQ ID NO: 1526), SLLMWITQC**KLENGGFPV**SLLMWITQC (SEQ ID NO: 1527) |
| | amino acids 155-163 of NY-ESO-1 | **KLENGGFPV**QLSLLMWIT (SEQ ID NO: 1528), QLSLLMWIT**KLENGGFPV**QLSLLMWIT (SEQ ID NO: 1529) |
| | amino acids 157-170 of NY-ESO-1 and amino acids 281-295 of MAGE-3 | SLLMWITQCFLPVF**KLENGGFPV**TSYVKVLHHMVKISG (SEQ ID NO: 1530) |
| Analog of K104-C112 of SEQ ID NO: 2 having leucine substituted for cysteine at the ninth amino acid residue (KITNSRPPL, SEQ ID NO: 172) | amino acids 161-169 of MAGE-1 | **KITNSRPPL**EADPTGHSY (SEQ ID NO: 1531), EADPTGHSY**KITNSRPPL**EADPTGHSY (SEQ ID NO: 1532) |
| | amino acids 230-238 of MAGE-1 | **KITNSRPPL**SAYGEPRKL (SEQ ID NO: 1533), SAYGEPRKL**KITNSRPPL**SAYGEPRKL (SEQ ID NO: 1534) |
| | amino acids 168-176 of MAGE-3 | **KITNSRPPL**EVDPIGHLY (SEQ ID NO: 1535), EVDPIGHLY**KITNSRPPL**EVDPIGHLY (SEQ ID NO: 1536) |
| | amino acids 271-279 of MAGE-3 | **KITNSRPPL** FLWGPRALV (SEQ ID NO: 1537), FLWGPRALV**KITNSRPPL**FLWGPRALV (SEQ ID NO: 1538) |
| | amino acids 167-176 of MAGE-3 | **KITNSRPPL** MEVDPIGHLY (SEQ ID NO: 1539), MEVDPIGHLY**KITNSRPPL**MEVDPIGHLY (SEQ ID NO: 1540) |
| | amino acids 2-10 of BAGE | **KITNSRPPL**AARAVFLAL (SEQ ID NO: 1541), AARAVFLAL**KITNSRPPL**AARAVFLAL (SEQ ID NO: 1542) |

TABLE C-continued

| C35 Epitope Analog | Exemplary Tumor Rejection Peptide | Exemplary Polytope |
|---|---|---|
| | amino acids 9-16 of GAGE-1,2 | **KITNSRPPL** YRPRPRRY (SEQ ID NO: 1543),<br>YRPRPRRY**KITNSRPPL**YRPRPRRY (SEQ ID NO: 1544) |
| | amino acids 11-20 of RAGE | **KITNSRPPL**SPSSNRIRNT (SEQ ID NO: 1545),<br>SPSSNRIRNT**KITNSRPPL**SPSSNRIRNT (SEQ ID NO: 1546) |
| | amino acids 23-32 of CDK4 | **KITNSRPPL**ARDPHSGHFV (SEQ ID NO: 1547),<br>ARDPHSGHFV**KITNSRPPL**ARDPHSGHFV (SEQ ID NO: 1548) |
| | amino acids 29-37 of β-catenin | **KITNSRPPL**SYLDSGIHS (SEQ ID NO: 1549),<br>SYLDSGIHS**KITNSRPPL**SYLDSGIHS (SEQ ID NO: 1550) |
| | amino acids 1-9 of Tyrosinase | **KITNSRPPL** MLLAVLYCL (SEQ ID NO: 1551),<br>MLLAVLYCL**KITNSRPPL**MLLAVLYCL (SEQ ID NO: 1552) |
| | amino acids 206-214 of Tyrosinase | **KITNSRPPL**AFLPWHRLF (SEQ ID NO: 1553),<br>AFLPWHRLF**KITNSRPPL**AFLPWHRLF (SEQ ID NO: 1554) |
| | amino acids 56-70 of Tyrosinase | **KITNSRPPL**QNILLSNAPLGPQFP (SEQ ID NO: 1555),<br>QNILLSNAPLGPQFP**KITNSRPPL**QNILLSNAPLGPQFP (SEQ ID NO: 1556) |
| | amino acids 448-462 of Tyrosinase | **KITNSRPPL**DYSYLQDSDPDSFQD (SEQ ID NO: 1557),<br>DYSYLQDSDPDSFQD**KITNSRPPL**DYSYLQDSDPDSFQD (SEQ ID NO: 1558) |
| | amino acids 32-40 of Melan-$A^{MART-1}$ | **KITNSRPPL**JLTVILGVL (SEQ ID NO: 1559),<br>JLTVILGVL**KITNSRPPL**JLTVILGVL (SEQ ID NO: 1560) |
| | amino acids 154-162 of $gp100^{Pmel17}$ | **KITNSRPPL**KTWGQYWQV (SEQ ID NO: 1561),<br>KTWGQYWQV**KITNSRPPL**KTWGQYWQV (SEQ ID NO: 1562) |
| | amino acids 209-217 of $gp100^{Pmel17}$ | **KITNSRPPL**ITDQVPFSV (SEQ ID NO: 1563),<br>ITDQVPFSV**KITNSRPPL**ITDQVPFSV (SEQ ID NO: 1564) |
| | amino acids 280-288 of $gp100^{Pmel17}$ | **KITNSRPPL**YLEPGPVTA (SEQ ID NO: 1565),<br>YLEPGPVTA**KITNSRPPL**YLEPGPVTA (SEQ ID NO: 1566) |
| | amino acids 457-466 of $gp100^{Pmel17}$ | **KITNSRPPL**LLDGTATLRL (SEQ ID NO: 1567),<br>LLDGTATLRL**KITNSRPPL**LLDGTATLRL (SEQ ID NO: 1568) |
| | amino acids 476-485 of $gp100^{Pmel17}$ | **KITNSRPPL**VLYRYGSFSV (SEQ ID NO: 1569),<br>VLYRYGSFSV**KITNSRPPL**VLYRYGSFSV (SEQ ID NO: 1570) |
| | amino acids 301-309 of PRAME | **KITNSRPPL**LYVDSLFFL (SEQ ID NO: 1571),<br>LYVDSLFFL**KITNSRPPL**LYVDSLFFL (SEQ ID NO: 1572) |
| | amino acids 292-303 of MAGE-6 | **KITNSRPPL**KISGGPRISYPL (SEQ ID NO: 1573),<br>KISGGPRISYPL**KITNSRPPL**KISGGPRISYPL (SEQ ID NO: 1574) |
| | amino acids 157-167 of NY-ESO-1 | **KITNSRPPL**SLLMWITQCFL (SEQ ID NO: 1575),<br>SLLMWITQCFL**KITNSRPPL**SLLMWITQCFL (SEQ ID NO: 1576) |

TABLE C-continued

| C35 Epitope Analog | Exemplary Tumor Rejection Peptide | Exemplary Polytope |
|---|---|---|
| | amino acids 157-165 of NY-ESO-1 | **KITNSRPPL**SLLMWITQC (SEQ ID NO: 1577),<br>SLLMWITQC**KITNSRPPL**SLLMWITQC (SEQ ID NO: 1578) |
| | amino acids 155-163 of NY-ESO-1 | **KITNSRPPL**QLSLLMWIT (SEQ ID NO: 1579),<br>QLSLLMWIT**KITNSRPPL**QLSLLMWIT (SEQ ID NO: 1580) |
| | amino acids 157-170 of NY-ESO-1 and amino acids 281-295 of MAGE-3 | SLLMWITQCFLPVF**KITNSRPPL**TSYVKVLHHMVKISG (SEQ ID NO: 1581) |
| Analog of I105-V113 of SEQ ID NO: 2 having leucine substituted for threonine at the second amino acid residue and alanine substituted for cysteine at the eighth amino acid residue (ILNSRPPAV, SEQ ID NO: 183) | amino acids 161-169 of MAGE-1 | **ILNSRPPAV**EADPTGHSY (SEQ ID NO: 1582),<br>EADPTGHSY**ILNSRPPAV**EADPTGHSY (SEQ ID NO: 1583) |
| | amino acids 230-238 of MAGE-1 | **ILNSRPPAV**SAYGEPRKL (SEQ ID NO: 1584),<br>SAYGEPRKL**ILNSRPPAV**SAYGEPRKL (SEQ ID NO: 1585) |
| | amino acids 168-176 of MAGE-3 | **ILNSRPPAV**EVDPIGHLY (SEQ ID NO: 1586),<br>EVDPIGHLY**ILNSRPPAV**EVDPIGHLY (SEQ ID NO: 1587) |
| | amino acids 271-279 of MAGE-3 | **ILNSRPPAV**FLWGPRALV (SEQ ID NO: 1588),<br>FLWGPRALV**ILNSRPPAV**FLWGPRALV (SEQ ID NO: 1589) |
| | amino acids 167-176 of MAGE-3 | **ILNSRPPAV**MEVDPIGHLY (SEQ ID NO: 1590),<br>MEVDPIGHLY**ILNSRPPAV**MEVDPIGHLY (SEQ ID NO: 1591) |
| | amino acids 2-10 of BAGE | **ILNSRPPAV**AARAVFLAL (SEQ ID NO: 1592),<br>AARAVFLAL**ILNSRPPAV**AARAVFLAL (SEQ ID NO: 1593) |
| | amino acids 9-16 of GAGE-1,2 | **ILNSRPPAV**YRPRPRRY (SEQ ID NO: 1594),<br>YRPRPRRY**ILNSRPPAV**YRPRPRRY (SEQ ID NO: 1595) |
| | amino acids 11-20 of RAGE | **ILNSRPPAV**SPSSNRIRNT (SEQ ID NO: 1596),<br>SPSSNRIRNT**ILNSRPPAV**SPSSNRIRNT (SEQ ID NO: 1597) |
| | amino acids 23-32 of CDK4 | **ILNSRPPAV**ARDPHSGHFV (SEQ ID NO: 1598),<br>ARDPHSGHFV**ILNSRPPAV**ARDPHSGHFV (SEQ ID NO: 1599) |
| | amino acids 29-37 of β-catenin | **ILNSRPPAV**SYLDSGIHS (SEQ ID NO: 1600),<br>SYLDSGIHS **ILNSRPPAV**SYLDSGIHS (SEQ ID NO: 1601) |
| | amino acids 1-9 of Tyrosinase | **ILNSRPPAV**MLLAVLYCL (SEQ ID NO: 1602),<br>MLLAVLYCL**ILNSRPPAV**MLLAVLYCL (SEQ ID NO: 1603) |
| | amino acids 206-214 of Tyrosinase | **ILNSRPPAV**AFLPWHRLF (SEQ ID NO :1604),<br>AFLPWHRLF**ILNSRPPAV**AFLPWHRLF (SEQ ID NO: 1605) |

TABLE C-continued

| C35 Epitope Analog | Exemplary Tumor Rejection Peptide | Exemplary Polytope |
|---|---|---|
| | amino acids 56-70 of Tyrosinase | **ILNSRPPAV**QNILLSNAPLGPQFP (SEQ ID NO: 1606),<br>QNILLSNAPLGPQFP**ILNSRPPAV**QNILLSNAPLGPQFP (SEQ ID NO: 1607) |
| | amino acids 448-462 of Tyrosinase | **ILNSRPPAV**DYSYLQDSDPDSFQD (SEQ ID NO: 1608),<br>DYSYLQDSDPDSFQD**ILNSRPPAV**DYSYLQDSDPDSFQD (SEQ ID NO: 1609) |
| | amino acids 32-40 of Melan-$A^{MART-1}$ | **ILNSRPPAV**JLTVILGVL (SEQ ID NO: 1610),<br>JLTVILGVL**ILNSRPPAV**JLTVILGVL (SEQ ID NO: 1611) |
| | amino acids 154-162 of $gp100^{Pmel17}$ | **ILNSRPPAV**KTWGQYWQV (SEQ ID NO: 1612),<br>KTWGQYWQV**ILNSRPPAV**KTWGQYWQV (SEQ ID NO: 1613) |
| | amino acids 209-217 of $gp100^{Pmel17}$ | **ILNSRPPAV**ITDQVPFSV (SEQ ID NO: 1614),<br>ITDQVPFSV**ILNSRPPAV**ITDQVPFSV (SEQ ID NO: 1615) |
| | amino acids 280-288 of $gp100^{Pmel17}$ | **ILNSRPPAV**YLEPGPVTA (SEQ ID NO: 1616),<br>YLEPGPVTA**ILNSRPPAV**YLEPGPVTA (SEQ ID NO: 1617) |
| | amino acids 457-466 of $gp100^{Pmel17}$ | **ILNSRPPAV**LLDGTATLRL (SEQ ID NO: 1618),<br>LLDGTATLRL**ILNSRPPAV**LLDGTATLRL (SEQ ID NO: 1619) |
| | amino acids 476-485 of $gp100^{Pmel17}$ | **ILNSRPPAV**VLYRYGSFSV (SEQ ID NO: 1620),<br>VLYRYGSFSV**ILNSRPPAV**VLYRYGSFSV (SEQ ID NO: 1621) |
| | amino acids 301-309 of PRAME | **ILNSRPPAV**LYVDSLFFL (SEQ ID NO: 1622)<br>LYVDSLFFL**ILNSRPPAV**LYVDSLFFL (SEQ ID NO: 1623) |
| | amino acids 292-303 of MAGE-6 | **ILNSRPPAV**KISGGPRISYPL (SEQ ID NO: 1624),<br>KISGGPRISYPL**ILNSRPPAV**KISGGPRISYPL (SEQ ID NO: 1625) |
| | amino acids 157-167 of NY-ESO-1 | **ILNSRPPAV**SLLMWITQCFL (SEQ ID NO: 1626),<br>SLLMWITQCFL**ILNSRPPAV**VSLLMWITQCFL (SEQ ID NO: 1627) |
| | amino acids 157-165 of NY-ESO-1 | **ILNSRPPAV**SLLMWITQC (SEQ ID NO: 1628),<br>SLLMWITQC**ILNSRPPAV**SLLMWITQC (SEQ ID NO: 1629) |
| | amino acids 155-163 of NY-ESO-1 | **ILNSRPPAV**QLSLLMWIT (SEQ ID NO: 1630),<br>QLSLLMWIT**ILNSRPPAV**QLSLLMWIT (SEQ ID NO: 1631) |
| | amino acids 157-170 of NY-ESO-1 and amino acids 281-295 of MAGE-3 | SLLMWITQCFLPVF **ILNSRPPAV**TSYVKVLHHMVKISG (SEQ ID NO: 1632) |

TABLE C-continued

| C35 Epitope Analog | Exemplary Tumor Rejection Peptide | Exemplary Polytope |
|---|---|---|
| Analog of I105-V113 of SEQ ID NO: 2 having methionine substituted for threonine at the second amino acids residue and alanine substituted for cysteine at the eighth amino acid residue (IMNSRPPAV, SEQ ID NO: 185) | amino acids 161-169 of MAGE-1 | **IMNSRPPAV** EADPTGHSY (SEQ ID NO: 1633), EADPTGHSY**IMNSRPPAV**EADPTGHSY (SEQ ID NO: 1634) |
| | amino acids 230-238 of MAGE-1 | **IMNSRPPAV** SAYGEPRKL (SEQ ID NO: 1635), SAYGEPRKL**IMNSRPPAV** SAYGEPRKL (SEQ ID NO: 1636) |
| | amino acids 168-176 of MAGE-3 | **IMNSRPPAV**EVDPIGHLY (SEQ ID NO: 1637), EVDPIGHLY**IMNSRPPAV** EVDPIGHLY (SEQ ID NO: 1638) |
| | amino acids 271-279 of MAGE-3 | **IMNSRPPAV**FLWGPRALV (SEQ ID NO: 1639), FLWGPRALV**IMNSRPPAV** FLWGPRALV (SEQ ID NO: 1640) |
| | amino acids 167-176 of MAGE-3 | **IMNSRPPAV**MEVDPIGHLY (SEQ ID NO: 1641), MEVDPIGHLY**IMNSRPPAV**MEVDPIGHLY (SEQ ID NO: 1642) |
| | amino acids 2-10 of BAGE | **IMNSRPPAV**AARAVFLAL (SEQ ID NO: 1643), AARAVFLAL**IMNSRPPAV**AARAVFLAL (SEQ ID NO: 1644) |
| | amino acids 9-16 of GAGE-1,2 | **IMNSRPPAV**YRPRPRRY (SEQ ID NO: 1645), YRPRPRRY**IMNSRPPAV**YRPRPRRY (SEQ ID NO: 1646) |
| | amino acids 11-20 of RAGE | **IMNSRPPAV**SPSSNRIRNT (SEQ ID NO: 1647), SPSSNRIRNT**IMNSRPPAV**SPSSNRIRNT (SEQ ID NO: 1648) |
| | amino acids 23-32 of CDK4 | **IMNSRPPAV**ARDPHSGHFV (SEQ ID NO: 1649), ARDPHSGHFV**IMNSRPPAV**ARDPHSGHFV (SEQ ID NO: 1650) |
| | amino acids 29-37 of β-catenin | **IMNSRPPAV**SYLDSGIHS (SEQ ID NO: 1651), SYLDSGIHS**IMNSRPPAV**SYLDSGIHS (SEQ ID NO: 1652) |
| | amino acids 1-9 of Tyrosinase | **IMNSRPPAV**MLLAVLYCL (SEQ ID NO: 1653), MLLAVLYCL**IMNSRPPAV**MLLAVLYCL (SEQ ID NO: 1654) |
| | amino acids 206-214 of Tyrosinase | **IMNSRPPAV**AFLPWHRLF (SEQ ID NO: 1655), AFLPWHRLF**IMNSRPPAV**AFLPWHRLF (SEQ ID NO: 1656) |
| | amino acids 56-70 of Tyrosinase | **IMNSRPPAV**QNILLSNAPLGPQFP (SEQ ID NO: 1657), QNILLSNAPLGPQFP**IMNSRPPAV**QNILLSNAPLGPQFP (SEQ ID NO: 1658) |
| | amino acids 448-462 of Tyrosinase | **IMNSRPPAV**DYSYLQDSDPDSFQD (SEQ ID NO: 1659), DYSYLQDSDPDSFQD**IMNSRPPAV**DYSYLQDSDPDSFQD (SEQ ID NO: 1660) |
| | amino acids 32-40 of Melan-$A^{MART-1}$ | **IMNSRPPAV**JLTVILGVL (SEQ ID NO: 1661), JLTVILGVL**IMNSRPPAV**JLTVILGVL (SEQ ID NO: 1662) |

TABLE C-continued

| C35 Epitope Analog | Exemplary Tumor Rejection Peptide | Exemplary Polytope |
|---|---|---|
| | amino acids 154-162 of gp100$^{Pmel17}$ | **IMNSRPPAV**KTWGQYWQV (SEQ ID NO: 1663),<br>KTWGQYWQV**IMNSRPPAV**KTWGQYWQV (SEQ ID NO: 1664) |
| | amino acids 209-217 of gp100$^{Pmel17}$ | **IMNSRPPAV**ITDQVPFSV (SEQ ID NO: 1665),<br>ITDQVPFSV**IMNSRPPAV**ITDQVPFSV (SEQ ID NO: 1666) |
| | amino acids 280-288 of gp100$^{Pmel17}$ | **IMNSRPPAV**YLEPGPVTA (SEQ ID NO: 1667),<br>YLEPGPVTA**IMNSRPPAV**YLEPGPVTA (SEQ ID NO: 1668) |
| | amino acids 457-466 of gp100$^{Pmel17}$ | **IMNSRPPAV**LLDGTATLRL (SEQ ID NO: 1669),<br>LLDGTATLRL**IMNSRPPAV**LLDGTATLRL (SEQ ID NO: 1670) |
| | amino acids 476-485 of gp100$^{Pmel17}$ | **IMNSRPPAV**VLYRYGSFSV (SEQ ID NO: 1671),<br>VLYRYGSFSV**IMNSRPPAV**VLYRYGSFSV (SEQ ID NO: 1672) |
| | amino acids 301-309 of PRAME | **IMNSRPPAV** LYVDSLFFL (SEQ ID NO: 1673),<br>LYVDSLFFL**IMNSRPPAV**LYVDSLFFL (SEQ ID NO: 1674) |
| | amino acids 292-303 of MAGE-6 | **IMNSRPPAV**KISGGPRISYPL (SEQ ID NO: 1675),<br>KISGGPRISYPL**IMNSRPPAV**KISGGPRISYPL (SEQ ID NO: 1676) |
| | amino acids 157-167 of NY-ESO-1 | **IMNSRPPAV**SLLMWITQCFL (SEQ ID NO: 1677),<br>SLLMWITQCFL**ITNSRPPAV**SLLMWITQCFL (SEQ ID NO: 1678) |
| | amino acids 157-165 of NY-ESO-1 | **IMNSRPPAV**SLLMWITQC (SEQ ID NO: 1679),<br>SLLMWITQC**IMNSRPPAV**SLLMWITQC (SEQ ID NO: 1680) |
| | amino acids 155-163 of NY-ESO-1 | **IMNSRPPAV**QLSLLMWIT (SEQ ID NO: 1681),<br>QLSLLMWIT**IMNSRPPAV**QLSLLMWIT (SEQ ID NO: 1682) |
| | amino acids 157-170 of NY-ESO-1 and amino acids 281-295 of MAGE-3 | SLLMWITQCFLPVF**IMNSRPPAV**TSYVKVLHHMVKISG (SEQ ID NO: 1683) |
| Analog of I105-V113 of SEQ ID NO: 2 having serine substituted for cysteine at the eighth amino acid residue (ITNSRPPSV, SEQ ID NO: 189) | amino acids 161-169 of MAGE-1 | **ITNSRPPSV** EADPTGHSY (SEQ ID NO: 1684),<br>EADPTGHSY**ITNSRPPSV**EADPTGHSY (SEQ ID NO: 1685) |
| | amino acids 230-238 of MAGE-1 | **ITNSRPPSV** SAYGEPRKL (SEQ ID NO: 1686),<br>SAYGEPRKL**ITNSRPPSV** SAYGEPRKL (SEQ ID NO: 1687) |
| | amino acids 168-176 of MAGE-3 | **ITNSRPPSV**EVDPIGHLY (SEQ ID NO: 1688),<br>EVDPIGHLY**ITNSRPPSV** EVDPIGHLY (SEQ ID NO: 1689) |
| | amino acids 271-279 of MAGE-3 | **ITNSRPPSV**FLWGPRALV (SEQ ID NO: 1690),<br>FLWGPRALV**ITNSRPPSV** FLWGPRALV (SEQ ID NO: 1691) |
| | amino acids 167-176 of MAGE-3 | **ITNSRPPSV**MEVDPIGHLY (SEQ ID NO: 1692),<br>MEVDPIGHLY**ITNSRPPSV**MEVDPIGHLY (SEQ ID NO: 1693) |

TABLE C-continued

| C35 Epitope Analog | Exemplary Tumor Rejection Peptide | Exemplary Polytope |
|---|---|---|
| | amino acids 2-10 of BAGE | **ITNSRPPSV**AARAVFLAL (SEQ ID NO: 1694),<br>AARAVFLAL**ITNSRPPSV**AARAVFLAL (SEQ ID NO: 1695) |
| | amino acids 9-16 of GAGE-1,2 | **ITNSRPPSV**YRPRPRRY (SEQ ID NO: 1696),<br>YRPRPRRY**ITNSRPPSV**YRPRPRRY (SEQ ID NO: 1697) |
| | amino acids 11-20 of RAGE | **ITNSRPPSV**SPSSNRIRNT (SEQ ID NO: 1698),<br>SPSSNRIRNT**ITNSRPPSV**SPSSNRIRNT (SEQ ID NO: 1699) |
| | amino acids 23-32 of CDK4 | **ITNSRPPSV**ARDPHSGHFV (SEQ ID NO: 1700),<br>ARDPHSGHFV**ITNSRPPSV**ARDPHSGHFV (SEQ ID NO: 1701) |
| | amino acids 29-37 of β-catenin | **ITNSRPPSV**SYLDSGIHS (SEQ ID NO: 1702),<br>SYLDSGIHS**ITNSRPPSV**SYLDSGIHS (SEQ ID NO: 1703) |
| | amino acids 1-9 of Tyrosinase | **ITNSRPPSV**MLLAVLYCL (SEQ ID NO: 1704),<br>MLLAVLYCL**ITNSRPPSV**MLLAVLYCL (SEQ ID NO: 1705) |
| | amino acids 206-214 of Tyrosinase | **ITNSRPPSV**AFLPWHRLF (SEQ ID NO: 1706),<br>AFLPWHRLF**ITNSRPPSV**AFLPWHRLF (SEQ ID NO: 1707) |
| | amino acids 56-70 of Tyrosinase | **ITNSRPPSV**QNILLSNAPLGPQFP (SEQ ID NO: 1708),<br>QNILLSNAPLGPQFP**ITNSRPPSV**QNILLSNAPLGPQFP (SEQ ID NO: 1709) |
| | amino acids 448-462 of Tyrosinase | **ITNSRPPSV**DYSYLQDSDPDSFQD (SEQ ID NO: 1710),<br>DYSYLQDSDPDSFQD**ITNSRPPSV**DYSYLQDSDPDSFQD (SEQ ID NO: 1711) |
| | amino acids 32-40 of Melan-$A^{MART-1}$ | **ITNSRPPSV**JLTVILGVL (SEQ ID NO: 1712),<br>JLTVILGVL**ITNSRPPSV**JLTVILGVL (SEQ ID NO: 1713) |
| | amino acids 154-162 of $gp100^{Pmel17}$ | **ITNSRPPSV**KTWGQYWQV (SEQ ID NO: 1714),<br>KTWGQYWQV**ITNSRPPSV**KTWGQYWQV (SEQ ID NO: 1715) |
| | amino acids 209-217 of $gp100^{Pmel17}$ | **ITNSRPPSV**ITDQVPFSV (SEQ ID NO: 1716),<br>ITDQVPFSV**ITNSRPPSV**ITDQVPFSV (SEQ ID NO: 1717) |
| | amino acids 280-288 of $gp100^{Pmel17}$ | **ITNSRPPSV**YLEPGPVTA (SEQ ID NO: 1718),<br>YLEPGPVTA**ITNSRPPSV**YLEPGPVTA (SEQ ID NO: 1719) |
| | amino acids 457-466 of $gp100^{Pmel17}$ | **ITNSRPPSV**LLDGTATLRL (SEQ ID NO: 1720),<br>LLDGTATLRL**ITNSRPPSV**LLDGTATLRL (SEQ ID NO: 1721) |
| | amino acids 476-485 of $gp100^{Pmel17}$ | **ITNSRPPSV**VLYRYGSFSV (SEQ ID NO: 1722),<br>VLYRYGSFSV**ITNSRPPSV**VLYRYGSFSV (SEQ ID NO: 1723) |
| | amino acids 301-309 of PRAME | **ITNSRPPSV** LYVDSLFFL (SEQ ID NO: 1724),<br>LYVDSLFFL**ITNSRPPSV**LYVDSLFFL (SEQ ID NO: 1725) |
| | amino acids 292-303 of MAGE-6 | **ITNSRPPSV** KISGGPRISYPL (SEQ ID NO: 1726),<br>KISGGPRISYPL**ITNSRPPSV**KISGGPRISYPL (SEQ ID NO: 1727) |

TABLE C-continued

| C35 Epitope Analog | Exemplary Tumor Rejection Peptide | Exemplary Polytope |
|---|---|---|
| | amino acids 157-167 of NY-ESO-1 | **ITNSRPPSV**SLLMWITQCFL (SEQ ID NO: 1728), SLLMWITQCFL**ITNSRPPSV**SLLMWITQCFL (SEQ ID NO: 1729) |
| | amino acids 157-165 of NY-ESO-1 | **ITNSRPPSV**SLLMWITQC (SEQ ID NO: 1730), SLLMWITQC**ITNSRPPSV**SLLMWITQC (SEQ ID NO: 1731) |
| | amino acids 155-163 of NY-ESO-1 | **ITNSRPPSV**QLSLLMWIT (SEQ ID NO: 1732), QLSLLMWIT**IMNSRPPSV**QLSLLMWIT (SEQ ID NO: 1733) |
| | amino acids 157-170 of NY-ESO-1 and amino acids 281-295 of MAGE-3 | SLLMWITQCFLPVF**ITNSRPPSV**TSYVKVLHHMVKISG (SEQ ID NO: 1734) |
| Analog of K104-V113 of SEQ ID NO: 2 having serine substituted for cysteine at the ninth amino acid residue (KITNSRPPSV, SEQ ID NO: 178) | amino acids 161-169 of MAGE-1 | **KITNSRPPSV** EADPTGHSY (SEQ ID NO: 1735), EADPTGHSY**KITNSRPPSV**EADPTGHSY (SEQ ID NO: 1736) |
| | amino acids 230-238 of MAGE-1 | **KITNSRPPSV** SAYGEPRKL (SEQ ID NO: 1737), SAYGEPRKL**KITNSRPPSV** SAYGEPRKL (SEQ ID NO: 1738) |
| | amino acids 168-176 of MAGE-3 | **KITNSRPPSV**EVDPIGHLY (SEQ ID NO: 1739), EVDPIGHLY**KITNSRPPSV** EVDPIGHLY (SEQ ID NO: 1740) |
| | amino acids 271-279 of MAGE-3 | **KITNSRPPSV**FLWGPRALV (SEQ ID NO: 1741), FLWGPRALV**KITNSRPPSV** FLWGPRALV (SEQ ID NO: 1742) |
| | amino acids 167-176 of MAGE-3 | **KITNSRPPSV**MEVDPIGHLY (SEQ ID NO: 1743), MEVDPIGHLY**KITNSRPPSV**MEVDPIGHLY (SEQ ID NO: 1744) |
| | amino acids 2-10 of BAGE | **KITNSRPPSV**AARAVFLAL (SEQ ID NO: 1745), AARAVFLAL**KITNSRPPSV**AARAVFLAL (SEQ ID NO: 1746) |
| | amino acids 9-16 of GAGE-1,2 | **KITNSRPPSV**YRPRPRRY (SEQ ID NO: 1747), YRPRPRRY**KITNSRPPSV**YRPRPRRY (SEQ ID NO: 1748) |
| | amino acids 11-20 of RAGE | **KITNSRPPSV**SPSSNRIRNT (SEQ ID NO: 1749), SPSSNRIRNT**KITNSRPPSV**SPSSNRIRNT (SEQ ID NO: 1750) |
| | amino acids 23-32 of CDK4 | **KITNSRPPSV**ARDPHSGHFV (SEQ ID NO: 1751), ARDPHSGHFV**KITNSRPPSV**ARDPHSGHFV (SEQ ID NO: 1752) |
| | amino acids 29-37 of β-catenin | **KITNSRPPSV**SYLDSGIHS (SEQ ID NO: 1753), SYLDSGIHS**KITNSRPPSV**SYLDSGIHS (SEQ ID NO: 1754) |
| | amino acids 1-9 of Tyrosinase | **KITNSRPPSV**MLLAVLYCL (SEQ ID NO: 1755), MLLAVLYCL**KITNSRPPSV**MLLAVLYCL (SEQ ID NO: 1756) |

TABLE C-continued

| C35 Epitope Analog | Exemplary Tumor Rejection Peptide | Exemplary Polytope |
|---|---|---|
| | amino acids 206-214 of Tyrosinase | **KITNSRPPSV**AFLPWHRLF (SEQ ID NO: 1757), AFLPWHRLF**KITNSRPPSV**AFLPWHRLF (SEQ ID NO: 1758) |
| | amino acids 56-70 of Tyrosinase | **KITNSRPPSV**QNILLSNAPLGPQFP (SEQ ID NO: 1759), QNILLSNAPLGPQFP**KITNSRPPSV**QNILLSNAPLGPQFP (SEQ ID NO: 1760) |
| | amino acids 448-462 of Tyrosinase | **KITNSRPPSV**DYSYLQDSDPDSFQD (SEQ ID NO: 1761), DYSYLQDSDPDSFQD**KITNSRPPSV**DYSYLQDSDPDSFQD (SEQ ID NO: 1762) |
| | amino acids 32-40 of Melan-A$^{MART-1}$ | **KITNSRPPSV**JLTVILGVL (SEQ ID NO: 1763), JLTVILGVL**KITNSRPPSV**JLTVILGVL (SEQ ID NO: 1764) |
| | amino acids 154-162 of gp100$^{Pmel17}$ | **KITNSRPPSV**KTWGQYWQV (SEQ ID NO: 1765), KTWGQYWQV**KITNSRPPSV**KTWGQYWQV (SEQ ID NO: 1766) |
| | amino acids 209-217 of gp100$^{Pmel17}$ | **KITNSRPPSV**ITDQVPFSV (SEQ ID NO: 1767), ITDQVPFSV**KITNSRPPSV**ITDQVPFSV (SEQ ID NO: 1768) |
| | amino acids 280-288 of gp100$^{Pmel17}$ | **KITNSRPPSV**YLEPGPVTA (SEQ ID NO: 1769), YLEPGPVTA**KITNSRPPSV**YLEPGPVTA (SEQ ID NO: 1770) |
| | amino acids 457-466 of gp100$^{Pmel17}$ | **KITNSRPPSV**LLDGTATLRL (SEQ ID NO: 1771), LLDGTATLRL**KITNSRPPSV**LLDGTATLRL (SEQ ID NO: 1772) |
| | amino acids 476-485 of gp100$^{Pmel17}$ | **KITNSRPPSV**VLYRYGSFSV (SEQ ID NO: 1773), VLYRYGSFSV**KITNSRPPSV**VLYRYGSFSV (SEQ ID NO: 1774) |
| | amino acids 301-309 of PRAME | **KITNSRPPSV**LYVDSLFFL (SEQ ID NO: 1775), LYVDSLFFL**KITNSRPPSV**LYVDSLFFL (SEQ ID NO: 1776) |
| | amino acids 292-303 of MAGE-6 | **KITNSRPPSV**KISGGPRISYPL (SEQ ID NO: 1777), KISGGPRISYPL**KITNSRPPSV**KISGGPRISYPL (SEQ ID NO: 1778) |
| | amino acids 157-167 of NY-ESO-1 | **KITNSRPPSV**SLLMWITQCFL (SEQ ID NO: 1779), SLLMWITQCFL**KITNSRPPSV**SLLMWITQCFL (SEQ ID NO: 1780) |
| | amino acids 157-165 of NY-ESO-1 | **KITNSRPPSV**SLLMWITQC (SEQ ID NO: 1781), SLLMWITQC**KITNSRPPSV**SLLMWITQC (SEQ ID NO: 1782) |
| | amino acids 155-163 of NY-ESO-1 | **KITNSRPPSV**QLSLLMWIT (SEQ ID NO: 1783), QLSLLMWIT**KITNSRPPSV**QLSLLMWIT (SEQ ID NO: 1784) |
| | amino acids 157-170 of NY-ESO-1 and amino acids 281-295 of MAGE-3 | SLLMWITQCFLPVF**KITNSRPPSV**TSYVKVLHHMVKISG (SEQ ID NO: 1785) |

TABLE C-continued

| C35 Epitope Analog | Exemplary Tumor Rejection Peptide | Exemplary Polytope |
|---|---|---|
| Analog of G22-C30 of SEQ ID NO: 2 having alanine substituted for cysteine at the ninth amino acid residue (GVRIVVEYA, SEQ ID NO: 161) | amino acids 161-169 of MAGE-1 | **GVRIVVEYA**EADPTGHSY (SEQ ID NO: 1786),<br>EADPTGHSY**GVRIVVEYA**EADPTGHSY (SEQ ID NO: 1787) |
| | amino acids 230-238 of MAGE-1 | **GVRIVVEYA**SAYGEPRKL (SEQ ID NO: 1788),<br>SAYGEPRKL**GVRIVVEYA**SAYGEPRKL (SEQ ID NO: 1789) |
| | amino acids 168-176 of MAGE-3 | **GVRIVVEYA** EVDPIGHLY (SEQ ID NO: 1790),<br>EVDPIGHLY**GVRIVVEYA**EVDPIGHLY (SEQ ID NO: 1791) |
| | amino acids 271-279 of MAGE-3 | **GVRIVVEYA**FLWGPRALV (SEQ ID NO: 1792),<br>FLWGPRALV**GVRIVVEYA**FLWGPRALV (SEQ ID NO: 1793) |
| | amino acids 167-176 of MAGE-3 | **GVRIVVEYA**MEVDPIGHLY (SEQ ID NO: 1794),<br>MEVDPIGHLY**GVRIVVEYA**MEVDPIGHLY (SEQ ID NO: 1795) |
| | amino acids 2-10 of BAGE | **GVRIVVEYA**AARAVFLAL (SEQ ID NO: 1796),<br>AARAVFLAL**GVRIVVEYA**AARAVFLAL (SEQ ID NO: 1797) |
| | amino acids 9-16 of GAGE-1,2 | **GVRIVVEYA**YRPRPRRY (SEQ ID NO: 1798),<br>YRPRPRRY**GVRIVVEYA**YRPRPRRY (SEQ ID NO: 1799) |
| | amino acids 11-20 of RAGE | **GVRIVVEYA**SPSSNRIRNT (SEQ ID NO: 1491),<br>SPSSNRIRNT**GVRIVVEYA**SPSSNRIRNT (SEQ ID NO: 1492) |
| | amino acids 23-32 of CDK4 | **GVRIVVEYA**ARDPHSGHFV (SEQ ID NO: 1493),<br>ARDPHSGHFV**GVRIVVEYA**ARDPHSGHFV (SEQ ID NO: 1494) |
| | amino acids 29-37 of β-catenin | **GVRIVVEYA**SYLDSGIHS (SEQ ID NO: 1495),<br>SYLDSGIHS**GVRIVVEYA**SYLDSGIHS (SEQ ID NO: 1496) |
| | amino acids 1-9 of Tyrosinase | **GVRIVVEYA**MLLAVLYCL (SEQ ID NO: 1497),<br>MLLAVLYCL**GVRIVVEYA**MLLAVLYCL (SEQ ID NO: 1498) |
| | amino acids 206-214 of Tyrosinase | **GVRIVVEYA**AFLPWHRLF (SEQ ID NO: 1499),<br>AFLPWHRLF**GVRIVVEYA**AFLPWHRLF (SEQ ID NO: 2131) |
| | amino acids 56-70 of Tyrosinase | **GVRIVVEYA**QNILLSNAPLGPQFP (SEQ ID NO: 2132),<br>QNILLSNAPLGPQFP**GVRIVVEYA**QNILLSNAPLGPQFP (SEQ ID NO: 2133) |
| | amino acids 448-462 of Tyrosinase | **GVRIVVEYA**DYSYLQDSDPDSFQD (SEQ ID NO: 2134),<br>DYSYLQDSDPDSFQD**GVRIVVEYA**DYSYLQDSDPDSFQD (SEQ ID NO: 2135) |
| | amino acids 32-40 of Melan-$A^{MART-1}$ | **GVRIVVEYA**JLTVILGVL (SEQ ID NO: 2136),<br>JLTVILGVL**GVRIVVEYA**JLTVILGVL (SEQ ID NO: 2137) |
| | amino acids 154-162 of $gp100^{Pmel17}$ | **GVRIVVEYA**KTWGQYWQV (SEQ ID NO: 2138),<br>KTWGQYWQV**GVRIVVEYA**KTWGQYWQV (SEQ ID NO: 2139) |

TABLE C-continued

| C35 Epitope Analog | Exemplary Tumor Rejection Peptide | Exemplary Polytope |
|---|---|---|
| | amino acids 209-217 of $gp100^{Pmel17}$ | **GVRIVVEYA**ITDQVPFSV (SEQ ID NO: 2140),<br>ITDQVPFSV**GVRIVVEYA**ITDQVPFSV (SEQ ID NO: 2141) |
| | amino acids 280-288 of $gp100^{Pmel17}$ | **GVRIVVEYA**YLEPGPVTA (SEQ ID NO: 1800),<br>YLEPGPVTA**GVRIVVEYA**YLEPGPVTA (SEQ ID NO: 1801) |
| | amino acids 457-466 of $gp100^{Pmel17}$ | **GVRIVVEYA**LLDGTATLRL (SEQ ID NO: 1802),<br>LLDGTATLRL**GVRIVVEYA**LLDGTATLRL (SEQ ID NO: 1803) |
| | amino acids 476-485 of $gp100^{Pmel17}$ | **KLENGGFPV**VLYRYGSFSV (SEQ ID NO: 1804),<br>VLYRYGSFSV**KLENGGFPV**VLYRYGSFSV (SEQ ID NO: 1805) |
| | amino acids 301-309 of PRAME | **GVRIVVEYA**LYVDSLFFL (SEQ ID NO: 1806),<br>LYVDSLFFL**GVRIVVEYA**LYVDSLFFL (SEQ ID NO: 1807) |
| | amino acids 292-303 of MAGE-6 | **GVRIVVEYA**KISGGPRISYPL (SEQ ID NO: 1808),<br>KISGGPRISYPL**GVRIVVEYA**KISGGPRISYPL (SEQ ID NO: 1809) |
| | amino acids 157-167 of NY-ESO-1 | **GVRIVVEYA**SLLMWITQCFL (SEQ ID NO: 1810),<br>SLLMWITQCFL**GVRIVVEYA**SLLMWITQCFL (SEQ ID NO: 1811) |
| | amino acids 157-165 of NY-ESO-1 | **GVRIVVEYA**SLLMWITQC (SEQ ID NO: 1812),<br>SLLMWITQC **GVRIVVEYA**SLLMWITQC (SEQ ID NO: 1813) |
| | amino acids 155-163 of NY-ESO-1 | **GVRIVVEYA**QLSLLMWIT (SEQ ID NO: 1814),<br>QLSLLMWIT **GVRIVVEYA**QLSLLMWIT (SEQ ID NO: 1815) |
| | amino acids 157-170 of NY-ESO-1and amino acids 281-295 of MAGE-3 | SLLMWITQCFLPVF **GVRIVVEYA**TSYVKVLHHMVKISG (SEQ ID NO: 1816) |
| Analog of I25-C33 of SEQ ID NO: 2 having alanine substituted for cysteine at the sixth and ninth amino acids residues (IVVEYAEPA, SEQ ID NO: 167) | amino acids 161-169 of MAGE-1 | **IVVEYAEPA**EADPTGHSY (SEQ ID NO: 1817),<br>EADPTGHSY**IVVEYAEPA**EADPTGHSY (SEQ ID NO: 1818) |
| | amino acids 230-238 of MAGE-1 | **IVVEYAEPA**SAYGEPRKL (SEQ ID NO: 1819),<br>SAYGEPRKL**IVVEYAEPA**SAYGEPRKL (SEQ ID NO: 1820) |
| | amino acids 168-176 of MAGE-3 | **IVVEYAEPA**EVDPIGHLY (SEQ ID NO: 1821),<br>EVDPIGHLY**IVVEYAEPA**EVDPIGHLY (SEQ ID NO: 1822) |
| | amino acids 271-279 of MAGE-3 | **IVVEYAEPA**FLWGPRALV (SEQ ID NO: 1823),<br>FLWGPRALV**IVVEYAEPA**FLWGPRALV (SEQ ID NO: 1824) |
| | amino acids 167-176 of MAGE-3 | **IVVEYAEPA**MEVDPIGHLY (SEQ ID NO: 1825),<br>MEVDPIGHLY**IVVEYAEPA**MEVDPIGHLY (SEQ ID NO: 1826) |
| | amino acids 2-10 of BAGE | **IVVEYAEPA**AARAVFLAL (SEQ ID NO: 1827),<br>AARAVFLAL**IVVEYAEPA**AARAVFLAL (SEQ ID NO: 1828) |

TABLE C-continued

| C35 Epitope Analog | Exemplary Tumor Rejection Peptide | Exemplary Polytope |
|---|---|---|
| | amino acids 9-16 of GAGE-1,2 | **IVVEYAEPA**YRPRPRRY (SEQ ID NO: 1829),<br>YRPRPRRY**IVVEYAEPA**YRPRPRRY (SEQ ID NO: 1830) |
| | amino acids 11-20 of RAGE | **IVVEYAEPA**SPSSNRIRNT (SEQ ID NO: 1831),<br>SPSSNRIRNT**IVVEYAEPA**SPSSNRIRNT (SEQ ID NO: 1832) |
| | amino acids 23-32 of CDK4 | **IVVEYAEPA**ARDPHSGHFV (SEQ ID NO: 1833),<br>ARDPHSGHFV**IVVEYAEPA**ARDPHSGHFV (SEQ ID NO: 1834) |
| | amino acids 29-37 of β-catenin | **IVVEYAEPA**SYLDSGIHS (SEQ ID NO: 1835),<br>SYLDSGIHS**IVVEYAEPA**SYLDSGIHS (SEQ ID NO: 1836) |
| | amino acids 1-9 of Tyrosinase | **IVVEYAEPA**MLLAVLYCL (SEQ ID NO: 1837),<br>MLLAVLYCL**IVVEYAEPA**MLLAVLYCL (SEQ ID NO: 1838) |
| | amino acids 206-214 of Tyrosinase | **IVVEYAEPA**AFLPWHRLF (SEQ ID NO: 1839),<br>AFLPWHRLF**IVVEYAEPA**AFLPWHRLF (SEQ ID NO: 1840) |
| | amino acids 56-70 of Tyrosinase | **IVVEYAEPA**QNILLSNAPLGPQFP (SEQ ID NO: 1841),<br>QNILLSNAPLGPQFP**IVVEYAEPA**QNILLSNAPLGPQFP (SEQ ID NO: 1842) |
| | amino acids 448-462 of Tyrosinase | **IVVEYAEPA**DYSYLQDSDPDSFQD (SEQ ID NO: 1843),<br>DYSYLQDSDPDSFQD**IVVEYAEPA**DYSYLQDSDPDSFQD (SEQ ID NO: 1844) |
| | amino acids 32-40 of Melan-A$^{MART-1}$ | **IVVEYAEPA**VJLTVILGVL (SEQ ID NO: 1845),<br>JLTVILGVL**IVVEYAEPA**JLTVILGVL (SEQ ID NO: 1846) |
| | amino acids 154-162 of gp100$^{Pmel17}$ | **IVVEYAEPA**KTWGQYWQV (SEQ ID NO: 1847),<br>KTWGQYWQV**IVVEYAEPA**KTWGQYWQV (SEQ ID NO: 1848) |
| | amino acids 209-217 of gp100$^{Pmel17}$ | **IVVEYAEPA**ITDQVPFSV (SEQ ID NO: 1849),<br>ITDQVPFSV**IVVEYAEPA**ITDQVPFSV (SEQ ID NO: 1850) |
| | amino acids 280-288 of gp100$^{Pmel17}$ | **IVVEYAEPA**YLEPGPVTA (SEQ ID NO: 1851),<br>YLEPGPVTA**IVVEYAEPA**YLEPGPVTA (SEQ ID NO: 1852) |
| | amino acids 457-466 of gp100$^{Pmel17}$ | **IVVEYAEPA**LLDGTATLRL (SEQ ID NO: 1853),<br>LLDGTATLRL**IVVEYAEPA**LLDGTATLRL (SEQ ID NO: 1854) |
| | amino acids 476-485 of gp100$^{Pmel17}$ | **IVVEYAEPA**VLYRYGSFSV (SEQ ID NO: 1855),<br>VLYRYGSFSV**IVVEYAEPA**VLYRYGSFSV (SEQ ID NO: 1856) |
| | amino acids 301-309 of PRAME | **IVVEYAEPA**LYVDSLFFL (SEQ ID NO: 1857),<br>LYVDSLFFL**IVVEYAEPA**LYVDSLFFL (SEQ ID NO: 1858) |
| | amino acids 292-303 of MAGE-6 | **IVVEYAEPA**KISGGPRISYPL (SEQ ID NO: 1859),<br>KISGGPRISYPL**IVVEYAEPA**KISGGPRISYPL (SEQ ID NO: 1860) |
| | amino acids 157-167 of NY-ESO-1 | **IVVEYAEPA**SLLMWITQCFL (SEQ ID NO: 1861),<br>SLLMWITQCFL**IVVEYAEPA**SLLMWITQCFL (SEQ ID NO: 1862) |

TABLE C-continued

| C35 Epitope Analog | Exemplary Tumor Rejection Peptide | Exemplary Polytope |
|---|---|---|
| | amino acids 157-165 of NY-ESO-1 | **IVVEYAEPA**SLLMWITQC (SEQ ID NO: 1863),<br>SLLMWITQC**IVVEYAEPA**SLLMWITQC (SEQ ID NO: 1864) |
| | amino acids 155-163 of NY-ESO-1 | **IVVEYAEPA**QLSLLMWIT (SEQ ID NO: 1865),<br>QLSLLMWIT **IVVEYAEPA**QLSLLMWIT (SEQ ID NO: 1866) |
| | amino acids 157-170 of NY-ESO-1 and amino acids 281-295 of MAGE-3 | SLLMWITQCFLPVF **IVVEYAEPA**TSYVKVLHHMVKISG (SEQ ID NO: 1867) |
| Analog of K104-C112 of SEQ ID NO: 2 having alanine substituted for cysteine at the ninth amino acid residue (KITNSRPPA, SEQ ID NO: 173) | amino acids 161-169 of MAGE-1 | **KITNSRPPA**EADPTGHSY (SEQ ID NO: 1868),<br>EADPTGHSY **KITNSRPPA**EADPTGHSY (SEQ ID NO: 1869) |
| | amino acids 230-238 of MAGE-1 | **KITNSRPPA**SAYGEPRKL (SEQ ID NO: 1870),<br>SAYGEPRKL**KITNSRPPA**SAYGEPRKL (SEQ ID NO: 1871) |
| | amino acids 168-176 of MAGE-3 | **KITNSRPPA**EVDPIGHLY (SEQ ID NO: 1872),<br>EVDPIGHLY**KITNSRPPA**EVDPIGHLY (SEQ ID NO: 1873) |
| | amino acids 271-279 of MAGE-3 | **KITNSRPPA**FLWGPRALV (SEQ ID NO: 1874),<br>FLWGPRALV**KITNSRPPA**FLWGPRALV (SEQ ID NO: 1875) |
| | amino acids 167-176 of MAGE-3 | **KITNSRPPA**MEVDPIGHLY (SEQ ID NO: 1876),<br>MEVDPIGHLY**KITNSRPPA**MEVDPIGHLY (SEQ ID NO: 1877) |
| | amino acids 2-10 of BAGE | **KITNSRPPA**AARAVFLAL (SEQ ID NO: 1878),<br>AARAVFLAL**KITNSRPPA**AARAVFLAL (SEQ ID NO: 1879) |
| | amino acids 9-16 of GAGE-1,2 | **KITNSRPPA**YRPRPRRY (SEQ ID NO: 1880),<br>YRPRPRRY**KITNSRPPA**YRPRPRRY (SEQ ID NO: 1881) |
| | amino acids 11-20 of RAGE | **KITNSRPPA**SPSSNRIRNT (SEQ ID NO: 1882),<br>SPSSNRIRNT**KITNSRPPA**SPSSNRIRNT (SEQ ID NO: 1883) |
| | amino acids 23-32 of CDK4 | **KITNSRPPA**ARDPHSGHFV (SEQ ID NO: 1884),<br>ARDPHSGHFV**KITNSRPPA**ARDPHSGHFV (SEQ ID NO: 1885) |
| | amino acids 29-37 of β-catenin | **KITNSRPPA**SYLDSGIHS (SEQ ID NO: 1886),<br>SYLDSGIHS**KITNSRPPA**SYLDSGIHS (SEQ ID NO: 1887) |
| | amino acids 1-9 of Tyrosinase | **KITNSRPPA**MLLAVLYCL (SEQ ID NO: 1888),<br>MLLAVLYCL**KITNSRPPA**MLLAVLYCL (SEQ ID NO: 1889) |
| | amino acids 206-214 of Tyrosinase | **KITNSRPPA**AFLPWHRLF (SEQ ID NO: 1890),<br>AFLPWHRLF**KITNSRPPA**AFLPWHRLF (SEQ ID NO: 1891) |
| | amino acids 56-70 of Tyrosinase | **KITNSRPPA**QNILLSNAPLGPQFP (SEQ ID NO: 1892),<br>QNILLSNAPLGPQFP **KITNSRPPA**QNILLSNAPLGPQFP (SEQ ID NO: 1893) |

TABLE C-continued

| C35 Epitope Analog | Exemplary Tumor Rejection Peptide | Exemplary Polytope |
|---|---|---|
| | amino acids 448-462 of Tyrosinase | **KITNSRPPA**DYSYLQDSDPDSFQD (SEQ ID NO: 1894),<br>DYSYLQDSDPDSFQD**KITNSRPPA**DYSYLQDSDPDSFQD (SEQ ID NO: 1895) |
| | amino acids 32-40 of Melan-$A^{MART-1}$ | **KITNSRPPA**JLTVILGVL (SEQ ID NO: 1896),<br>JLTVILGVL**KITNSRPPA**JLTVILGVL (SEQ ID NO: 1897) |
| | amino acids 154-162 of $gp100^{Pmel17}$ | **KITNSRPPA**KTWGQYWQV (SEQ ID NO: 1898),<br>KTWGQYWQV**KITNSRPPA**KTWGQYWQV (SEQ ID NO: 1899) |
| | amino acids 209-217 of $gp100^{Pmel17}$ | **KITNSRPPA**ITDQVPFSV (SEQ ID NO: 1900),<br>ITDQVPFSV**KITNSRPPA**ITDQVPFSV (SEQ ID NO: 1901) |
| | amino acids 280-288 of $gp100^{Pmel17}$ | **KITNSRPPA**YLEPGPVTA (SEQ ID NO: 1902),<br>YLEPGPVTA**KITNSRPPA**YLEPGPVTA (SEQ ID NO: 1903) |
| | amino acids 457-466 of $gp100^{Pmel17}$ | **KITNSRPPA**LLDGTATLRL (SEQ ID NO: 1904),<br>LLDGTATLRL**KITNSRPPA**LLDGTATLRL (SEQ ID NO: 1905) |
| | amino acids 476-485 of $gp100^{Pmel17}$ | **KITNSRPPA**VLYRYGSFSV (SEQ ID NO: 1906),<br>VLYRYGSFSV**KITNSRPPA**VLYRYGSFSV (SEQ ID NO: 1907) |
| | amino acids 301-309 of PRAME | **KITNSRPPA**LYVDSLFFL (SEQ ID NO: 1908),<br>LYVDSLFFL**KITNSRPPA**LYVDSLFFL (SEQ ID NO: 1909) |
| | amino acids 292-303 of MAGE-6 | **KITNSRPPA**KISGGPRISYPL (SEQ ID NO: 1910),<br>KISGGPRISYPL**KITNSRPPA**KISGGPRISYPL (SEQ ID NO: 1911) |
| | amino acids 157-167 of NY-ESO-1 | **KITNSRPPA**SLLMWITQCFL (SEQ ID NO: 1912),<br>SLLMWITQCFL**KITNSRPPA**SLLMWITQCFL (SEQ ID NO: 1913) |
| | amino acids 157-165 of NY-ESO-1 | **KITNSRPPA**SLLMWITQC (SEQ ID NO: 1914),<br>SLLMWITQC**KITNSRPPA**SLLMWITQC (SEQ ID NO: 1915) |
| | amino acids 155-163 of NY-ESO-1 | **KITNSRPPA**QLSLLMWIT (SEQ ID NO: 1916),<br>QLSLLMWIT**KITNSRPPA**QLSLLMWIT (SEQ ID NO: 1917) |
| | amino acids 157-170 of NY-ESO-1 and amino acids 281-295 of MAGE-3 | SLLMWITQCFLPVF**KITNSRPPA**TSYVKVLHHMVKISG (SEQ ID NO: 1918) |

TABLE D

| C35 Epitope | Exemplary Cell-Penetrating Peptide Sequence (CPP) | Exemplary Polypeptide Containing C35 Epitope and CPP |
|---|---|---|
| S9-V17 of SEQ ID NO: 2<br>SVAPPPEEV | HSV-1 tegument protein VP22 | **SVAPPPEEV**MTSRRSVKSGPREVPRDEYEDLYYTPSSGMASPDSPPDTSRRGALQTRSRQRGEVR<br>FVQYDESDYALYGGSSSEDDEHPEVPRTRRPVSGAVLSGPGPARAPPPPAGSGGAGRTPTTAPRA<br>PRTQRVATKAPAAPAAETTRGRKSAQPESAALPDAPASTAPTRSKTPAQGLARKLHFSTAPPNPD<br>APWTPRVAGFNKRVFCAAVGRLAAMHARMAAVQLWDMSRPRTDEDLNELLGITTIRVTVCEG<br>KNLLQRANELVNPDVVQDVDAATATRGRSAASRPTERPRAPARSASRPRRPVE (SEQ ID NO: 1919),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**SVAPPPEEV**MTSRRSVKSGPR<br>EVPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 1920) |
| | membrane-translocating sequence (MST) from h region of the signal sequence of Kaposi fibroblast growth factor | **SVAPPPEEV**AAVLLPVLLAAP (SEQ ID NO: 1921),<br>AAVLLPVLLAAP**SVAPPPEEV**AAVLLPVLLAAP (SEQ ID NO: 1922) |
| S21-Y29 of SEQ ID NO: 2<br>SGVRIVVEY | HSV-1 tegument protein VP22 | **SGVRIVVEY**MTSRRSVKSGPREVPRDEYEDLYYTPSSGMASPDSPPDTSRRGALQTRSRQRGEVR<br>FVQYDESDYALYGGSSSEDDEHPEVPRTRRPVSGAVLSGPGPARAPPPPAGSGGAGRTPTTAPRA<br>PRTQRVATKAPAAPAAETTRGRKSAQPESAALPDAPASTAPTRSKTPAQGLARKLHFSTAPPNPD<br>APWTPRVAGFNKRVFCAAVGRLAAMHARMAAVQLWDMSRPRTDEDLNELLGITTIRVTVCEG<br>KNLLQRANELVNPDVVQDVDAATATRGRSAASRPTERPRAPARSASRPRRPVE (SEQ ID NO: 1923),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**SGVRIVVEY**MTSRRSVKSGPR<br>EVPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 1924) |
| | membrane-translocating sequence (MST) from h region of the signal sequence of Kaposi fibroblast growth factor | **SGVRIVVEY**AAVLLPVLLAAP (SEQ ID NO: 1925),<br>AAVLLPVLLAAP**SGVRIVVEY**AAVLLPVLLAAP (SEQ ID NO: 1926) |
| G22-C30 of SEQ ID NO: 2<br>GVRIVVEYC | HSV-1 tegument protein VP22 | **GVRIVVEYC**MTSRRSVKSGPREVPRDEYEDLYYTPSSGMASPDSPPDTSRRGALQTRSRQRGEV<br>RFVQYDESDYALYGGSSSEDDEHPEVPRTRRPVSGAVLSGPGPARAPPPPAGSGGAGRTPTTAPR<br>APRTQRVATKAPAAPAAETTRGRKSAQPESAALPDAPASTAPTRSKTPAQGLARKLHFSTAPPNP<br>DAPWTPRVAGFNKRVFCAAVGRLAAMHARMAAVQLWDMSRPRTDEDLNELLGITTIRVTVCE<br>GKNLLQRANELVNPDVVQDVDAATATRGRSAASRPTERPRAPARSASRPRRPVE (SEQ ID NO: 1927),<br>MTSRRSVKSGPREVPRDEYEDLYYTPSSGMASPDSPPDTSRRGALQTRSRQRGEVRFVQYDESDY |

TABLE D-continued

| C35 Epitope | Exemplary Cell-Penetrating Peptide Sequence (CPP) | Exemplary Polypeptide Containing C35 Epitope and CPP |
|---|---|---|
| | | ALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE**GVRIVVEYC**MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE (SEQ ID NO: 1928) |
| | membrane-translocating sequence (MST) from h region of the signal sequence of Kaposi fibroblast growth factor | **GVRIVVEYC**AAVLLPVLLAAP (SEQ ID NO: 1929), AAVLLPVLLAAP**GVRIVVEYC**AAVLLPVLLAAP (SEQ ID NO: 1930) |
| I25-C33 of SEQ ID NO: 2 IVVEYCEPC | HSV-1 tegument protein VP22 | **IVVEYCEPC**MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE (SEQ ID NO: 1931), MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE**IVVEYCEPC**MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE (SEQ ID NO: 1932) |
| | membrane-translocating sequence (MST) from h region of the signal sequence of Kaposi fibroblast growth factor | **IVVEYCEPC**AAVLLPVLLAAP (SEQ ID NO: 1933), AAVLLPVLLAAP**IVVEYCEPC**AAVLLPVLLAAP (SEQ ID NO: 1934) |
| T38-V46 of SEQ ID NO: 2 TYLELASAV | HSV-1 tegument protein VP22 | **TYLELASAV**MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE (SEQ ID NO: 1935), MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE**TYLELASAV**MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRG |

TABLE D-continued

| C35 Epitope | Exemplary Cell-Penetrating Peptide Sequence (CPP) | Exemplary Polypeptide Containing C35 Epitope and CPP |
|---|---|---|
| | | RKSAQPESAALPDAPASTAPTRSKTPAQGLARKLHFSTAPPNPDAPWTPRVAGFNKRVFCAAVG RLAAMHARMAAVQLWDMSRPRTDEDLNELLGITTIRVTVCEGKNLLQRANELVNPDVVQDVD AATATRGRSAASRPTERPRAPARSASRPRRPVE (SEQ ID NO: 1936) |
| | membrane-translocating sequence (MST) from h region of the signal sequence of Kaposi fibroblast growth factor | **TYLELASAV**AAVLLPVLLAAP (SEQ ID NO: 1937), AAVLLPVLLAAP **TYLELASAV**AAVLLPVLLAAP (SEQ ID NO: 1938) |
| G61-I69 of SEQ ID NO: 2 GTGAFEIEI | HSV-1 tegument protein VP22 | **GTGAFEIEI**MTSRRSVKSGPREVPRDEYEDLYYTPSSGMASPDSPPDTSRRGALQTRSRQRGEVR FVQYDESDYALYGGSSSEDDEHPEVPRTRRPVSGAVLSGPGPARAPPPPAGSGGAGRTPTTAPRA PRTQRVATKAPAAPAAETTRGRKSAQPESAALPDAPASTAPTRSKTPAQGLARKLHFSTAPPNPD APWTPRVAGFNKRVFCAAVGRLAAMHARMAAVQLWDMSRPRTDEDLNELLGITTIRVTVCEG KNLLQRANELVNPDVVQDVDAATATRGRSAASRPTERPRAPARSASRPRRPVE (SEQ ID NO: 1939), MTSRRSVKSGPREVPRDEYEDLYYTPSSGMASPDSPPDTSRRGALQTRSRQRGEVRFVQYDESDY ALYGGSSSEDDEHPEVPRTRRPVSGAVLSGPGPARAPPPPAGSGGAGRTPTTAPRAPRTQRVATK APAAPAAETTRGRKSAQPESAALPDAPASTAPTRSKTPAQGLARKLHFSTAPPNPDAPWTPRVAG FNKRVFCAAVGRLAAMHARMAAVQLWDMSRPRTDEDLNELLGITTIRVTVCEGKNLLQRANEL VNPDVVQDVDAATATRGRSAASRPTERPRAPARSASRPRRPVE**GTGAFEIEI**MTSRRSVKSGPRE VPRDEYEDLYYTPSSGMASPDSPPDTSRRGALQTRSRQRGEVRFVQYDESDYALYGGSSSEDDE HPEVPRTRRPVSGAVLSGPGPARAPPPPAGSGGAGRTPTTAPRAPRTQRVATKAPAAPAAETTRG RKSAQPESAALPDAPASTAPTRSKTPAQGLARKLHFSTAPPNPDAPWTPRVAGFNKRVFCAAVG RLAAMHARMAAVQLWDMSRPRTDEDLNELLGITTIRVTVCEGKNLLQRANELVNPDVVQDVD AATATRGRSAASRPTERPRAPARSASRPRRPVE (SEQ ID NO: 1940) |
| | membrane-translocating sequence (MST) from h region of the signal sequence of Kaposi fibroblast growth factor | **GTGAFEIEI**AAVLLPVLLAAP (SEQ ID NO: 1941), AAVLLPVLLAAP**GTGAFEIEI**AAVLLPVLLAAP (SEQ ID NO: 1942) |
| F65-L73 of SEQ ID NO: 2 FEIEINGQL | HSV-1 tegument protein VP22 | **FEIEINGQL**MTSRRSVKSGPREVPRDEYEDLYYTPSSGMASPDSPPDTSRRGALQTRSRQRGEVR FVQYDESDYALYGGSSSEDDEHPEVPRTRRPVSGAVLSGPGPARAPPPPAGSGGAGRTPTTAPRA PRTQRVATKAPAAPAAETTRGRKSAQPESAALPDAPASTAPTRSKTPAQGLARKLHFSTAPPNPD APWTPRVAGFNKRVFCAAVGRLAAMHARMAAVQLWDMSRPRTDEDLNELLGITTIRVTVCEG KNLLQRANELVNPDVVQDVDAATATRGRSAASRPTERPRAPARSASRPRRPVE (SEQ ID NO: 1943), MTSRRSVKSGPREVPRDEYEDLYYTPSSGMASPDSPPDTSRRGALQTRSRQRGEVRFVQYDESDY ALYGGSSSEDDEHPEVPRTRRPVSGAVLSGPGPARAPPPPAGSGGAGRTPTTAPRAPRTQRVATK APAAPAAETTRGRKSAQPESAALPDAPASTAPTRSKTPAQGLARKLHFSTAPPNPDAPWTPRVAG FNKRVFCAAVGRLAAMHARMAAVQLWDMSRPRTDEDLNELLGITTIRVTVCEGKNLLQRANEL VNPDVVQDVDAATATRGRSAASRPTERPRAPARSASRPRRPVE**FEIEINGQL**MTSRRSVKSGPRE VPRDEYEDLYYTPSSGMASPDSPPDTSRRGALQTRSRQRGEVRFVQYDESDYALYGGSSSEDDE HPEVPRTRRPVSGAVLSGPGPARAPPPPAGSGGAGRTPTTAPRAPRTQRVATKAPAAPAAETTRG RKSAQPESAALPDAPASTAPTRSKTPAQGLARKLHFSTAPPNPDAPWTPRVAGFNKRVFCAAVG RLAAMHARMAAVQLWDMSRPRTDEDLNELLGITTIRVTVCEGKNLLQRANELVNPDVVQDVD AATATRGRSAASRPTERPRAPARSASRPRRPVE (SEQ ID NO: 1944) |

TABLE D-continued

| C35 Epitope | Exemplary Cell-Penetrating Peptide Sequence (CPP) | Exemplary Polypeptide Containing C35 Epitope and CPP |
|---|---|---|
| | membrane-translocating sequence (MST) from h region of the signal sequence of Kaposi fibroblast growth factor | **FEIEINGQL**AAVLLPVLLAAP (SEQ ID NO: 1945),<br>AAVLLPVLLAAP**FEIEINGQL**AAVLLPVLLAAP (SEQ ID NO: 1946) |
| I67-F75 of SEQ ID NO: 2<br>IEINGQLVF | HSV-1 tegument protein VP22 | **IEINGQLVF**MTSRRSVKSGPREVPRDEYEDLYYTPSSGMASPDSPPDTSRRGALQTRSRQRGEVR<br>FVQYDESDYALYGGSSSEDDEHPEVPRTRRPVSGAVLSGPGPARAPPPPAGSGGAGRTPTTAPRA<br>PRTQRVATKAPAAPAAETTRGRKSAQPESAALPDAPASTAPTRSKTPAQGLARKLHFSTAPPNPD<br>APWTPRVAGFNKRVFCAAVGRLAAMHARMAAVQLWDMSRPRTDEDLNELLGITTIRVTVCEG<br>KNLLQRANELVNPDVVQDVDAATATRGRSAASRPTERPRAPARSASRPRRPVE (SEQ ID NO: 1947),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**IEINGQLVF**MTSRRSVKSGPRE<br>VPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 1948) |
| | membrane-translocating sequence (MST) from h region of the signal sequence of Kaposi fibroblast growth factor | **IEINGQLVF**AAVLLPVLLAAP (SEQ ID NO: 1949),<br>AAVLLPVLLAAP**IEINGQLVF**AAVLLPVLLAAP (SEQ ID NO: 1950) |
| K77-Y85 of SEQ ID NO: 2<br>KLENGGFPY | HSV-1 tegument protein VP22 | **KLENGGFPY**MTSRRSVKSGPREVPRDEYEDLYYTPSSGMASPDSPPDTSRRGALQTRSRQRGEV<br>RFVQYDESDYALYGGSSSEDDEHPEVPRTRRPVSGAVLSGPGPARAPPPPAGSGGAGRTPTTAPR<br>APRTQRVATKAPAAPAAETTRGRKSAQPESAALPDAPASTAPTRSKTPAQGLARKLHFSTAPPNP<br>DAPWTPRVAGFNKRVFCAAVGRLAAMHARMAAVQLWDMSRPRTDEDLNELLGITTIRVTVCE<br>GKNLLQRANELVNPDVVQDVDAATATRGRSAASRPTERPRAPARSASRPRRPVE (SEQ ID NO: 1951),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**KLENGGFPY**MTSRRSVKSGPR<br>EVPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 1952) |
| | membrane-translocating sequence (MST) from h region of the signal sequence of Kaposi fibroblast growth factor | **KLENGGFPY**AAVLLPVLLAAP (SEQ ID NO: 1953),<br>AAVLLPVLLAAP**KLENGGFPY**AAVLLPVLLAAP (SEQ ID NO: 1954) |
| Q72-E86 of SEQ ID NO: 2<br>QLVFSKLENGGFPYE | HSV-1 tegument protein VP22 | **QLVFSKLENGGFPYE**MTSRRSVKSGPREVPRDEYEDLYYTPSSGMASPDSPPDTSRRGALQTRS<br>RQRGEVRFVQYDESDYALYGGSSSEDDEHPEVPRTRRPVSGAVLSGPGPARAPPPPAGSGGAGRT<br>PTTAPRAPRTQRVATKAPAAPAAETTRGRKSAQPESAALPDAPASTAPTRSKTPAQGLARKLHFS |

TABLE D-continued

| C35 Epitope | Exemplary Cell-Penetrating Peptide Sequence (CPP) | Exemplary Polypeptide Containing C35 Epitope and CPP |
|---|---|---|
| | | TAPPNPDAPWTPRVAGFNKRVFCAAVGRLAAMHARMAAVQLWDMSRPRTDEDLNELLGITTIR<br>VTVCEGKNLLQRANELVNPDVVQDVDAATATRGRSAASRPTERPRAPARSASRPRRPVE (SEQ ID NO: 1955),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRIPVE**QLVFSKLENGGFPYE**MTSRRS<br>VKSGPREVPRDEYEDLYYTPSSGMASPDSPPDTSRRGALQTRSRQRGEVRFVQYDESDYALYGG<br>SSSEDDEHPEVPRTRRPVSGAVLSGPGPARAPPPPAGSGGAGRTPTTAPRAPRTQRVATKAPAAP<br>AAETTRGRKSAQPESAALPDAPASTAPTRSKTPAQGLARKLHFSTAPPNPDAPWTPRVAGFNKRV<br>FCAAVGRLAAMHARMAAVQLWDMSRPRTDEDLNELLGITTIRVTVCEGKNLLQRANELVNPDV<br>VQDVDAATATRGRSAASRPTERPRAPARSASRPRRPVE (SEQ ID NO: 1956) |
| | membrane-translocating sequence (MST) from h region of the signal sequence of Kaposi fibroblast growth factor | **QLVFSKLENGGFPYE**AAVLLPVLLAAP (SEQ ID NO: 1957),<br>AAVLLPVLLAAP**QLVFSKLENGGFPYE**AAVLLPVLLAAP (SEQ ID NO: 1958) |
| G81-L89 of SEQ ID NO: 2<br>GGFPYEKDL | HSV-1 tegument protein VP22 | **GGFPYEKDL**MTSRRSVKSGPREVPRDEYEDLYYTPSSGMASPDSPPDTSRRGALQTRSRQRGEV<br>RFVQYDESDYALYGGSSSEDDEHPEVPRTRRPVSGAVLSGPGPARAPPPPAGSGGAGRTPTTAPR<br>APRTQRVATKAPAAPAAETTRGRKSAQPESAALPDAPASTAPTRSKTPAQGLARKLHFSTAPPNP<br>DAPWTPRVAGFNKRVFCAAVGRLAAMHARMAAVQLWDMSRPRTDEDLNELLGITTIRVTVCE<br>GKNLLQRANELVNPDVVQDVDAATATRGRSAASRPTERPRAPARSASRPRRPVE (SEQ ID NO: 1959),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRLPVE**GGFPYEKDL**MTSRRSVKSGPR<br>EVPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 1960) |
| | membrane-translocating sequence (MST) from h region of the signal sequence of Kaposi fibroblast growth factor | **GGFPYEKDL**AAVLLPVLLAAP (SEQ ID NO: 1961),<br>AAVLLPVLLAAP**GGFPYEKDL**AAVLLPVLLAAP (SEQ ID NO: 1962) |
| K104-C112 of SEQ ID NO: 2<br>KITNSRPPC | HSV-1 tegument protein VP22 | **KITNSRPPC**MTSRRSVKSGPREVPRDEYEDLYYTPSSGMASPDSPPDTSRRGALQTRSRQRGEVR<br>FVQYDESDYALYGGSSSEDDEHPEVPRTRRPVSGAVLSGPGPARAPPPPAGSGGAGRTPTTAPRA<br>PRTQRVATKAPAAPAAETTRGRKSAQPESAALPDAPASTAPTRSKTPAQGLARKLHFSTAPPNPD<br>APWTPRVAGFNKRVFCAAVGRLAAMHARMAAVQLWDMSRPRTDEDLNELLGITTIRVTVCEG<br>KNLLQRANELVNPDVVQDVDAATATRGRSAASRPTERPRAPARSASRPRRPVE (SEQ ID NO: 1963),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**KITNSRPPC**MTSRRSVKSGPRE<br>VPRDEYEDLYYTPSSGMASPDSPPDTSRRGALQTRSRQRGEVRFVQYDESDYALYGGSSSEDDE |

TABLE D-continued

| C35 Epitope | Exemplary Cell-Penetrating Peptide Sequence (CPP) | Exemplary Polypeptide Containing C35 Epitope and CPP |
|---|---|---|
| | | HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 1964) |
| | membrane-translocating sequence (MST) from h region of the signal sequence of Kaposi fibroblast growth factor | **KITNSRPPC**AAVLLPVLLAAP (SEQ ID NO: 1965),<br>AAVLLPVLLAAP**KITNSRPPC**AAVLLPVLLAAP (SEQ ID NO: 1966) |
| K104-V113 of SEQ ID NO: 2<br>KITNSRPPCV | HSV-1 tegument protein VP22 | **KITNSRPPCV**MTSRRSVKSGPREVPRDEYEDLYYTPSSGMASPDSPPDTSRRGALQTRSRQRGEV<br>RFVQYDESDYALYGGSSSEDDEHPEVPRTRRPVSGAVLSGPGPARAPPPPAGSGGAGRTPTTAPR<br>APRTQRVATKAPAAPAAETTRGRKSAQPESAALPDAPASTAPTRSKTPAQGLARKLHFSTAPPNP<br>DAPWTPRVAGFNKRVFCAAVGRLAAMHARMAAVQLWDMSRPRTDEDLNELLGITTIRVTVCE<br>GKNLLQRANELVNPDVVQDVDAATATRGRSAASRPTERPRAPARSASRPRRPVE (SEQ ID NO: 1967),<br>MTSRRSVKSGPREVPRDEYEDLYYTPSSGMASPDSPPDTSRRGALQTRSRQRGEVRPVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**KITNSRPPCV**MTSRRSVKSGP<br>REVPRDEYEDLYYTPSSGMASPDSPPDTSRRGALQTRSRQRGEVRFVQYDESDYALYGGSSSEDD<br>EHPEVPRTRRPVSGAVLSGPGPARAPPPPAGSGGAGRTPTTAPRAPRTQRVATKAPAAPAAETTR<br>GRKSAQPESAALPDAPASTAPTRSKTPAQGLARKLHFSTAPPNPDAPWTPRVAGFNKRVFCAAV<br>GRLAAMHARMAAVQLWDMSRPRTDEDLNELLGITTIRVTVCEGKNLLQRANELVNPDVVQDV<br>DAATATRGRSAASRPTERPRAPARSASRPRRPVE (SEQ ID NO: 1968) |
| | membrane-translocating sequence (MST) from h region of the signal sequence of Kaposi fibroblast growth factor | **KITNSRPPCV**AAVLLPVLLAAP (SEQ ID NO: 1969),<br>AAVLLPVLLAAP**KITNSRPPCV**AAVLLPVLLAAP (SEQ ID NO: 1970) |
| I105-V113 of SEQ ID NO: 2<br>ITNSRPPCV | HSV-1 tegument protein VP22 | **ITNSRPPCV**MTSRRSVKSGPREVPRDEYEDLYYTPSSGMASPDSPPDTSRRGALQTRSRQRGEVR<br>FVQYDESDYALYGGSS<br>SEDDEHPEVPRTRRPVSGAVLSGPGPARAPPPPAGSGGAGRTPTTAPRAPRTQRVATKAPAAPAA<br>ETTRGRKSAQPESAALPDAPASTAPTRSKTPAQGLARKLHFSTAPPNPDAPWTPRVAGFNKRVFC<br>AAVGRLAAMHARMAAVQLWDMSRPRTDEDLNELLGITTIRVTVCEGKNLLQRANELVNPDVV<br>QDVDAATATRGRSAASRPTERPRAPARSASRPRRPVE (SEQ ID NO: 1971),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**ITNSRPPCV**MTSRRSVKSGPRE<br>VPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 1972) |

TABLE D-continued

| C35 Epitope | Exemplary Cell-Penetrating Peptide Sequence (CPP) | Exemplary Polypeptide Containing C35 Epitope and CPP |
|---|---|---|
| | membrane-translocating sequence (MST) from h region of the signal sequence of Kaposi fibroblast growth factor | **ITNSRPPCV**AAVLLPVLLAAP (SEQ ID NO: 1973),<br>AAVLLPVLLAAP**ITNSRPPCV**AAVLLPVLLAAP (SEQ ID NO: 1974) |
| T101-V113 of SEQ ID NO: 2<br>LEKITNSRPPCVIL | HSV-1 tegument protein VP22 | **TLEKITNSRPPCV**MTSRRSVKSGPREVPRDEYEDLYYTPSSGMASPDSPPDTSRRGALQTRSRQR<br>GEVRFVQYDESDYALYGGSSSEDDEHPEVPRTRRPVSGAVLSGPGPARAPPPPAGSGGAGRTPTT<br>APRAPRTQRVATKAPAAPAAETTRGRKSAQPESAALPDAPASTAPTRSKTPAQGLARKLHFSTAP<br>PNPDAPWTPRVAGFNKRVFCAAVGRLAAMHARMAAVQLWDMSRPRTDEDLNELLGITTIRVTV<br>CEGKNLLQRANELVNPDVVQDVDAATATRGRSAASRPTERPRAPARSASRPRRPVE (SEQ ID NO: 1975),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**TLEKITNSRPPCV**MTSRRSVK<br>SGPREVPRDEYEDLYYTPSSGMASPDSPPDTSRRGALQTRSRQRGEVRFVQYDESDYALYGGSSS<br>EDDEHPEVPRTRRPVSGAVLSGPGPARAPPPPAGSGGAGRTPTTAPRAPRTQRVATKAPAAPAAE<br>TTRGRKSAQPESAALPDAPASTAPTRSKTPAQGLARKLHFSTAPPNPDAPWTPRVAGFNKRVFCA<br>AVGRLAAMHARMAAVQLWDMSRPRTDEDLNELLGITTIRVTVCEGKNLLQRANELVNPDVVQ<br>DVDAATATRGRSAASRPTERPRAPARSASRPRRPVE (SEQ ID NO: 1976) |
| | membrane-translocating sequence (MST) from h region of the signal sequence of Kaposi fibroblast growth factor | **TLEKITNSRPPCV**AAVLLPVLLAAP (SEQ ID NO: 1977),<br>AAVLLPVLLAAP**TLEKITNSRPPCV**AAVLLPVLLAAP (SEQ ID NO: 1978) |
| I93-V113 of SEQ ID NO: 2<br>IRRASNGETLEKITNSRPPCV | HSV-1 tegument protein VP22 | **IRRASNGETLEKITNSRPPCV**MTSRRSVKSGPREVPRDEYEDLYYTPSSGMASPDSPPDTSRRGA<br>LQTRSRQRGEVRFVQYDESDYALYGGSSSEDDEHPEVPRTRRPVSGAVLSGPGPARAPPPPAGSG<br>GAGRTPTTAPRAPRTQRVATKAPAAPAAETTRGRKSAQPESAALPDAPASTAPTRSKTPAQGLAR<br>KLHFSTAPPNPDAPWTPRVAGFNKRVFCAAVGRLAAMHARMAAVQLWDMSRPRTDEDLNELL<br>GITTIRVTVCEGKNLLQRANELVNPDVVQDVDAATATRGRSAASRPTERPRAPARSASRPRRPVE (SEQ ID NO: 1979),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**IRRASNGETLEKITNSRPPCV**<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE (SEQ ID NO: 1980) |
| | membrane-translocating sequence (MST) from h region of the signal sequence of Kaposi fibroblast growth factor | **IRRASNGETLEKITNSRPPCV**AAVLLPVLLAAP (SEQ ID NO: 1981),<br>AAVLLPVLLAAP**IRRASNGETLEKITNSRPPCV**AAVLLPVLLAAP (SEQ ID NO: 1982) |
| D88-V113 of SEQ ID NO: 2<br>DLIEAIRRASNGETLEKITNS<br>RPPCV | HSV-1 tegument protein VP22 | **DLIEAIRRASNGETLEKITNSRPPCV**MTSRRSVKSGPREVPRDEYEDLYYTPSSGMASPDSPPDT<br>SRRGALQTRSRQRGEVRFVQYDESDYALYGGSSSEDDEHPEVPRTRRPVSGAVLSGPGPARAPPP<br>PAGSGGAGRTPTTAPRAPRTQRVATKAPAAPAAETTRGRKSAQPESAALPDAPASTAPTRSKTPA |

TABLE D-continued

| C35 Epitope | Exemplary Cell-Penetrating Peptide Sequence (CPP) | Exemplary Polypeptide Containing C35 Epitope and CPP |
|---|---|---|
| | | QGLARKLHFSTAPPNPDAPWTPRVAGFNKRVFCAAVGRLAAMHARMAAVQLWDMSRPRTDED LNELLGITTIRVTVCEGKNLLQRANELVNPDVVQDVDAATATRGRSAASRPTERPRAPARSASRP RRPVE (SEQ ID NO: 1983), MTSRRSVKSGPREVPRDEYEDLYYTPSSGMASPDSPPDTSRRGALQTRSRQRGEVRFVQYDESDY ALYGGSSSEDDEHPEVPRTRRPVSGAVLSGPGPARAPPPPAGSGGAGRTPTTAPRAPRTQRVATK APAAPAAETTRGRKSAQPESAALPDAPASTAPTRSKTPAQGLARKLHFSTAPPNPDAPWTPRVAG FNKRVFCAAVGRLAAMHARMAAVQLWDMSRPRTDEDLNELLGITTIRVTVCEGKNLLQRANEL VNPDVVQDVDAATATRGRSAASRPTERPRAPARSASRPRRPVE**DLIEAIRRASNGETLEKITNSR PPCV**MTSRRSVKSGPREVPRDEYEDLYYTPSSGMASPDSPPDTSRRGALQTRSRQRGEVRFVQY DESDYALYGGSSSEDDEHPEVPRTRRPVSGAVLSGPGPARAPPPPAGSGGAGRTPTTAPRAPRTQ RVATKAPAAPAAETTRGRKSAQPESAALPDAPASTAPTRSKTPAQGLARKLHFSTAPPNPDAPWT PRVAGFNKRVFCAAVGRLAAMHARMAAVQLWDMSRPRTDEDLNELLGITTIRVTVCEGKNLLQ RANELVNPDVVQDVDAATATRGRSAASRPTERPRAPARSASRPRRPVE (SEQ ID NO: 1984) |
| | membrane-translocating sequence (MST) from h region of the signal sequence of Kaposi fibroblast growth factor | **DLIEAIRRASNGETLEKITNSRPPCV**AAVLLPVLLAAP (SEQ ID NO: 1985), AAVLLPVLLAAP**DLIEAIRRASNGETLEKITNSRPPCV**AAVLLPVLLAAP (SEQ ID NO: 1986) |
| P84-V113 of SEQ ID NO: 2 PYEKDLIEAIRRASNGETLE KITNSRPPCV | HSV-1 tegument protein VP22 | **PYEKDLIEAIRRASNGETLEKITNSRPPCV**MTSRRSVKSGPREVPRDEYEDLYYTPSSGMASPDS PPDTSRRGALQTRSRQRGEVRFVQYDESDYALYGGSSSEDDEHPEVPRTRRPVSGAVLSGPGPAR APPPPAGSGGAGRTPTTAPRAPRTQRVATKAPAAPAAETTRGRKSAQPESAALPDAPASTAPTRS KTPAQGLARKLHFSTAPPNPDAPWTPRVAGFNKRVFCAAVGRLAAMHARMAAVQLWDMSRPR TDEDLNELLGITTIRVTVCEGKNLLQRANELVNPDVVQDVDAATATRGRSAASRPTERPRAPARS ASRPRRPVE (SEQ ID NO: 1987), MTSRRSVKSGPREVPRDEYEDLYYTPSSGMASPDSPPDTSRRGALQTRSRQRGEVRFVQYDESDY ALYGGSSSEDDEHPEVPRTRRPVSGAVLSGPGPARAPPPPAGSGGAGRTPTTAPRAPRTQRVATK APAAPAAETTRGRKSAQPESAALPDAPASTAPTRSKTPAQGLARKLHFSTAPPNPDAPWTPRVAG FNKRVFCAAVGRLAAMHARMAAVQLWDMSRPRTDEDLNELLGITTIRVTVCEGKNLLQRANEL VNPDVVQDVDAATATRGRSAASRPTERPRAPARSASRPRRPVE**PYEKDLIEAIRRASNGETLEK ITNSRPPCV**MTSRRSVKSGPREVPRDEYEDLYYTPSSGMASPDSPPDTSRRGALQTRSRQRGEVR FVQYDESDYALYGGSSSEDDEHPEVPRTRRPVSGAVLSGPGPARAPPPPAGSGGAGRTPTTAPRA PRTQRVATKAPAAPAAETTRGRKSAQPESAALPDAPASTAPTRSKTPAQGLARKLHFSTAPPNPD APWTPRVAGFNKRVFCAAVGRLAAMHARMAAVQLWDMSRPRTDEDLNELLGITTIRVTVCEG KNLLQRANELVNPDVVQDVDAATATRGRSAASRPTERPRAPARSASRPRRPVE (SEQ ID NO: 1988) |
| | membrane-translocating sequence (MST) from h region of the signal sequence of Kaposi fibroblast growth factor | **PYEKDLIEAIRRASNGETLEKITNSRPPCV**AAVLLPVLLAAP (SEQ ID NO: 1989), AAVLLPVLLAAP**PYEKDLIEAIRRASNGETLEKITNSRPPCV**AAVLLPVLLAAP (SEQ ID NO: 1990) |
| K77-V113 of SEQ ID NO: 2 KLENGGFPYEKDLIEAIRRA SNGETLEKITNSRPPCV | HSV-1 tegument protein VP22 | **KLENGGFPYEKDLIEAIRRASNGETLEKITNSRPPCV**MTSRRSVKSGPREVPRDEYEDLYYTPS SGMASPDSPPDTSRRGALQTRSRQRGEVRFVQYDESDYALYGGSSSEDDEHPEVPRTRRPVSGAV LSGPGPARAPPPPAGSGGAGRTPTTAPRAPRTQRVATKAPAAPAAETTRGRKSAQPESAALPDAP ASTAPTRSKTPAQGLARKLHFSTAPPNPDAPWTPRVAGFNKRVFCAAVGRLAAMHARMAAVQL WDMSRPRTDEDLNELLGITTIRVTVCEGKNLLQRANELVNPDVVQDVDAATATRGRSAASRPTE RPRAPARSASRPRRPVE (SEQ ID NO: 1991), MTSRRSVKSGPREVPRDEYEDLYYTPSSGMASPDSPPDTSRRGALQTRSRQRGEVRFVQYDESDY ALYGGSSSEDDEHPEVPRTRRPVSGAVLSGPGPARAPPPPAGSGGAGRTPTTAPRAPRTQRVATK APAAPAAETTRGRKSAQPESAALPDAPASTAPTRSKTPAQGLARKLHFSTAPPNPDAPWTPRVAG |

TABLE D-continued

| C35 Epitope | Exemplary Cell-Penetrating Peptide Sequence (CPP) | Exemplary Polypeptide Containing C35 Epitope and CPP |
|---|---|---|
| | | FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**KLENGGFPYEKDLIEAIRRAS**<br>**NGETLEKITNSRPPCV**MTSRRSVKSGPREVPRDEYEDLYYTPSSGMASPDSPPDTSRRGALQTRS<br>RQRGEVRFVQYDESDYALYGGSSSEDDEHPEVPRTRRPVSGAVLSGPGPARAPPPPAGSGGAGRT<br>PTTAPRAPRTQRVATKAPAAPAAETTRGRKSAQPESAALPDAPASTAPTRSKTPAQGLARKLHFS<br>TAPPNPDAPWTPRVAGFNKRVFCAAVGRLAAMHARMAAVQLWDMSRPRTDEDLNELLGITTIR<br>VTVCEGKNLLQRANELVNPDVVQDVDAATATRGRSAASRPTERPRAPARSASRPRRPVE (SEQ ID NO: 1992) |
| | membrane-translocating sequence (MST) from h region of the signal sequence of Kaposi fibroblast growth factor | **KLENGGFPYEKDLIEAIRRASNGETLEKITNSRPPCV**AAVLLPVLLAAP (SEQ ID NO: 1993),<br>AAVLLPVLLAAP**KLENGGFPYEKDLIEAIRRASNGETLEKITNSRPPCV** AAVLLPVLLAAP (SEQ ID NO: 1994) |
| Q72-V113 of SEQ ID NO: 2<br>QLVFSKLENGGFPYEKDLIE<br>AIRRASNGETLEKITNSRPPCV | HSV-1 tegument protein VP22 | **QLVFSKLENGGFPYEKDLIEAIRRASNGETLEKITNSRPPCV**MTSRRSVKSGPREVPRDEYEDL<br>YYTPSSGMASPDSPPDTSRRGALQTRSRQRGEVRFVQYDESDYALYGGSSSEDDEHPEVPRTRRP<br>VSGAVLSGPGPARAPPPPAGSGGAGRTPTTAPRAPRTQRVATKAPAAPAAETTRGRKSAQPESAA<br>LPDAPASTAPTRSKTPAQGLARKLHFSTAPPNPDAPWTPRVAGFNKRVFCAAVGRLAAMHARM<br>AAVQLWDMSRPRTDEDLNELLGITTIRVTVCEGKNLLQRANELVNPDVVQDVDAATATRGRSA<br>ASRPTERPRAPARSASRPRRPVE (SEQ ID NO: 1995),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**QLVFSKLENGGFPYEKDLIEA**<br>**IRRASNGETLEKITNSRPPCV**MTSRRSVKSGPREVPRDEYEDLYYTPSSGMASPDSPPDTSRRGA<br>LQTRSRQRGEVRFVQYDESDYALYGGSSSEDDEHPEVPRTRRPVSGAVLSGPGPARAPPPPAGSG<br>GAGRTPTTAPRAPRTQRVATKAPAAPAAETTRGRKSAQPESAALPDAPASTAPTRSKTPAQGLAR<br>KLHFSTAPPNPDAPWTPRVAGFNKRVFCAAVGRLAAMHARMAAVQLWDMSRPRTDEDLNELL<br>GITTIRVTVCEGKNLLQRANELVNPDVVQDVDAATATRGRSAASRPTERPRAPARSASRPRRPVE (SEQ ID NO: 1996) |
| | membrane-translocating sequence (MST) from h region of the signal sequence of Kaposi fibroblast growth factor | **QLVFSKLENGGFPYEKDLIEAIRRASNGETLEKITNSRPPCV**AAVLLPVLLAAP (SEQ ID NO: 1997),<br>AAVLLPVLLAAP**QLVFSKLENGGFPYEKDLIEAIRRASNGETLEKITNSRPPCV**<br>AAVLLPVLLAAP (SEQ ID NO: 1998) |
| F65-V113 of SEQ ID NO: 2<br>FEIEINGQLVFSKLENGGFP<br>YEKDLIEAIRRASNGETLEKI<br>TNSRPPCV | HSV-1 tegument protein VP22 | **FEIEINGQLVFSKLENGGFPYEKDLIEAIRRASNGETLEKITNSRPPCV**MTSRRSVKSGPREV<br>PRDEYEDLYYTPSSGMASPDSPPDTSRRGALQTRSRQRGEVRFVQYDESDYALYGGSSSEDDEHP<br>EVPRTRRPVSGAVLSGPGPARAPPPPAGSGGAGRTPTTAPRAPRTQRVATKAPAAPAAETTRGRK<br>SAQPESAALPDAPASTAPTRSKTPAQGLARKLHFSTAPPNPDAPWTPRVAGFNKRVFCAAVGRL<br>AAMHARMAAVQLWDMSRPRTDEDLNELLGITTIRVTVCEGKNLLQRANELVNPDVVQDVDAA<br>TATRGRSAASRPTERPRAPARSASRPRRPVE (SEQ ID NO: 1999),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**FEIEINGQLVFSKLENGGFPY**<br>**EKDLIEAIRRASNGETLEKITNSRPPCV**MTSRRSVKSGPREVPRDEYEDLYYTPSSGMASPDSPP |

TABLE D-continued

| C35 Epitope | Exemplary Cell-Penetrating Peptide Sequence (CPP) | Exemplary Polypeptide Containing C35 Epitope and CPP |
|---|---|---|
| | | DTSRRGALQTRSRQRGEVRFVQYDESDYALYGGSSSEDDEHPEVPRTRRPVSGAVLSGPGPARAP<br>PPPAGSGGAGRTPTTAPRAPRTQRVATKAPAAPAAETTRGRKSAQPESAALPDAPASTAPTRSKT<br>PAQGLARKLHFSTAPPNPDAPWTPRVAGFNKRVFCAAVGRLAAMHARMAAVQLWDMSRPRTD<br>EDLNELLGITTIRVTVCEGKNLLQRANELVNPDVVQDVDAATATRGRSAASRPTERPRAPARSAS<br>RPRRPVE (SEQ ID NO: 2000) |
| | membrane-translocating sequence (MST) from h region of the signal sequence of Kaposi fibroblast growth factor | **FEIEINGQLVFSKLENGGFPYEKDLIEAIRRASNGETLEKITNSRPPCV**AAVLLPVLLAAP (SEQ ID NO: 2001),<br>AAVLLPVLLAAP**FEIEINGQLVFSKLENGGFPYEKDLIEAIRRASNGETLEKITNSRPPCV**<br>AAVLLPVLLAAP (SEQ ID NO: 2002) |
| L59-V113 of SEQ ID NO: 2<br>LGGTGAFEIEINGQLVFSKL<br>ENGGFPYEKDLIEAIRRASN<br>GETLEKITNSRPPCVIL | HSV-1 tegument protein VP22 | **LGGTGAFEIEINGQLVFSKLENGGFPYEKDLIEAIRRASNGETLEKITNSRPPCV**MTSRRSVKS<br>GPREVPRDEYEDLYYTPSSGMASPDSPPDTSRRGALQTRSRQRGEVRFVQYDESDYALYGGSSSE<br>DDEHPEVPRTRRPVSGAVLSGPGPARAPPPPAGSGGAGRTPTTAPRAPRTQRVATKAPAAPAAET<br>TRGRKSAQPESAALPDAPASTAPTRSKTPAQGLARKLHFSTAPPNPDAPWTPRVAGFNKRVFCAA<br>VGRLAAMHARMAAVQLWDMSRPRTDEDLNELLGITTIRVTVCEGKNLLQRANELVNPDVVQD<br>VDAATATRGRSAASRPTERPRAPARSASRPRRPVE (SEQ ID NO: 2003),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**LGGTGAFEIEINGQLVFSKLE**<br>**NGGFPYEKDLIEAIRRASNGETLEKITNSRPPCV**MTSRRSVKSGPREVPRDEYEDLYYTPSSGM<br>ASPDSPPDTSRRGALQTRSRQRGEVRFVQYDESDYALYGGSSSEDDEHPEVPRTRRPVSGAVLSG<br>PGPARAPPPPAGSGGAGRTPTTAPRAPRTQRVATKAPAAPAAETTRGRKSAQPESAALPDAPAST<br>APTRSKTPAQGLARKLHFSTAPPNPDAPWTPRVAGFNKRVFCAAVGRLAAMHARMAAVQLWD<br>MSRPRTDEDLNELLGITTIRVTVCEGKNLLQRANELVNPDVVQDVDAATATRGRSAASRPTERPR<br>APARSASRPRRPVE (SEQ ID NO: 2004) |
| | membrane-translocating sequence (MST) from h region of the signal sequence of Kaposi fibroblast growth factor | **LGGTGAFEIEINGQLVFSKLENGGFPYEKDLIEAIRRASNGETLEKITNSRPPCV**AAVLLPVLL<br>AAP (SEQ ID NO: 2005),<br>AVLLPVLLAAP**LGGTGAFEIEINGQLVFSKLENGGFPYEKDLIEAIRRASNGETLEKITNSRP**<br>**PCV**AAVLLPVLLAAP (SEQ ID NO: 2006) |
| G99-V113 of SEQ ID NO: 2<br>GETLEKITNSRPPCV | HSV-1 tegument protein VP22 | **GETLEKITNSRPPCV**MTSRRSVKSGPREVPRDEYEDLYYTPSSGMASPDSPPDTSRRGALQTRSR<br>QRGEVRFVQYDESDYALYGGSSSEDDEHPEVPRTRRPVSGAVLSGPGPARAPPPPAGSGGAGRTP<br>TTAPRAPRTQRVATKAPAAPAAETTRGRKSAQPESAALPDAPASTAPTRSKTPAQGLARKLHFST<br>APPNPDAPWTPRVAGFNKRVFCAAVGRLAAMHARMAAVQLWDMSRPRTDEDLNELLGITTIRV<br>TVCEGKNLLQRANELVNPDVVQDVDAATATRGRSAASRPTERPRAPARSASRPRRPVE (SEQ ID NO: 2007),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**GETLEKITNSRPPCV**MTSRRS<br>VKSGPREVPRDEYEDLYYTPSSGMASPDSPPDTSRRGALQTRSRQRGEVRFVQYDESDYALYGG<br>SSSEDDEHPEVPRTRRPVSGAVLSGPGPARAPPPPAGSGGAGRTPTTAPRAPRTQRVATKAPAAP<br>AAETTRGRKSAQPESAALPDAPASTAPTRSKTPAQGLARKLHFSTAPPNPDAPWTPRVAGFNKRV<br>FCAAVGRLAAMHARMAAVQLWDMSRPRTDEDLNELLGITTIRVTVCEGKNLLQRANELVNPDV<br>VQDVDAATATRGRSAASRPTERPRAPARSASRPRRPVE (SEQ ID NO: 2008) |

TABLE D-continued

| C35 Epitope | Exemplary Cell-Penetrating Peptide Sequence (CPP) | Exemplary Polypeptide Containing C35 Epitope and CPP |
|---|---|---|
| | membrane-translocating sequence (MST) from h region of the signal sequence of Kaposi fibroblast growth factor | **GETLEKITNSRPPCV**AAVLLPVLLAAP (SEQ ID NO: 2009),<br>AAVLLPVLLAAP**GETLEKITNSRPPCV**AAVLLPVLLAAP (SEQ ID NO: 2010) |
| E100-V113 of SEQ ID NO: 2<br>ETLEKITNSRPPCV | HSV-1 tegument protein VP22 | **ETLEKITNSRPPCV**MTSRRSVKSGPREVPRDEYEDLYYTPSSGMASPDSPPDTSRRGALQTRSRQ<br>RGEVRFVQYDESDYALYGGSSSEDDEHPEVPRTRRPVSGAVLSGPGPARAPPPPAGSGGAGRTPT<br>TAPRAPRTQRVATKAPAAPAAETTRGRKSAQPESAALPDAPASTAPTRSKTPAQGLARKLHFSTA<br>PPNPDAPWTPRVAGFNKRVFCAAVGRLAAMHARMAAVQLWDMSRPRTDEDLNELLGITTIRVT<br>VCEGKNLLQRANELVNPDVVQDVDAATATRGRSAASRPTERPRAPARSASRPRRPVE (SEQ ID NO: 2011),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**ETLEKITNSRPPCV**MTSRRSV<br>KSGPREVPRDEYEDLYYTPSSGMASPDSPPDTSRRGALQTRSRQRGEVRFVQYDESDYALYGGSS<br>SEDDEHPEVPRTRRPVSGAVLSGPGPARAPPPPAGSGGAGRTPTTAPRAPRTQRVATKAPAAPAA<br>ETTRGRKSAQPESAALPDAPASTAPTRSKTPAQGLARKLHFSTAPPNPDAPWTPRVAGFNKRVFC<br>AAVGRLAAMHARMAAVQLWDMSRPRTDEDLNELLGITTIRVTVCEGKNLLQRANELVNPDVV<br>QDVDAATATRGRSAASRPTERPRAPARSASRPRRPVE (SEQ ID NO: 2012) |
| | membrane-translocating sequence (MST) from h region of the signal sequence of Kaposi fibroblast growth factor | **ETLEKITNSRPPCV**AAVLLPVLLAAP (SEQ ID NO: 2013),<br>AAVLLPVLLAAP**ETLEKITNSRPPCV**AAVLLPVLLAAP (SEQ ID NO: 2014) |

TABLE E

| C35 Epitope Analog | Exemplary Cell-Penetrating Peptide Sequence (CPP) | Exemplary Polypeptide Containing C35 Epitope Analog and CPP |
|---|---|---|
| Analog of K77-Y85 of SEQ ID NO: 2 having valine substituted for tyrosine at ninth amino acid residue (KLENGGFPV, SEQ ID NO: 171) | HSV-1 tegument protein VP22 | **KLENGGFPV**MTSRRSVKSGPREVPRDEYEDLYYTPSSGMASPDSPPDTSRRGALQTRSRQRGEV<br>RFVQYDESDYALYGGSSSEDDEHPEVPRTRRPVSGAVLSGPGPARAPPPPAGSGGAGRTPTTAPR<br>APRTQRVATKAPAAPAAETTRGRKSAQPESAALPDAPASTAPTRSKTPAQGLARKLHFSTAPPNP<br>DAPWTPRVAGFNKRVFCAAVGRLAAMHARMAAVQLWDMSRPRTDEDLNELLGITTIRVTVCE<br>GKNLLQRANELVNPDVVQDVDAATATRGRSAASRPTERPRAPARSASRPRRPVE (SEQ ID NO: 2015),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**KLENGGFPV**MTSRRSVKSGPR<br>EVPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 2016) |
| | membrane-translocating sequence (MST) from h region of the signal sequence of Kaposi fibroblast growth factor | **KLENGGFPV**AAVLLPVLLAAP (SEQ ID NO: 2017),<br>AAVLLPVLLAAP**KLENGGFPV**AAVLLPVLLAAP (SEQ ID NO: 2018) |
| Analog of K104-C112 of SEQ ID NO: 2 having leucine substituted for cysteine at the ninth amino acid residue (KITNSRPPL, SEQ ID NO: 172) | HSV-1 tegument protein VP22 | **KITNSRPPL**MTSRRSVKSGPREVPRDEYEDLYYTPSSGMASPDSPPDTSRRGALQTRSRQRGEVR<br>FVQYDESDYALYGGSSSEDDEHPEVPRTRRPVSGAVLSGPGPARAPPPPAGSGGAGRTPTTAPRA<br>PRTQRVATKAPAAPAAETTRGRKSAQPESAALPDAPASTAPTRSKTPAQGLARKLHFSTAPPNPD<br>APWTPRVAGFNKRVFCAAVGRLAAMHARMAAVQLWDMSRPRTDEDLNELLGITTIRVTVCEG<br>KNLLQRANELVNPDVVQDVDAATATRGRSAASRPTERPRAPARSASRPRRPVE (SEQ ID NO: 2019),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**KITNSRPPL**MTSRRSVKSGPRE<br>VPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 2020) |
| | membrane-translocating sequence (MST) from h region of the signal sequence of Kaposi fibroblast growth factor | **KITNSRPPL**AAVLLPVLLAAP (SEQ ID NO: 2021),<br>AAVLLPVLLAAP**KITNSRPPL**AAVLLPVLLAAP (SEQ ID NO: 2022) |
| Aanalog of I105-V113 of SEQ ID NO: 2 having leucine substituted for threonine at the second amino acid residue and alanine substituted for cysteine at the eighth amino acid residue | HSV-1 tegument protein VP22 | **ILNSRPPAV**MTSRRSVKSGPREVPRDEYEDLYYTPSSGMASPDSPPDTSRRGALQTRSRQRGEVR<br>FVQYDESDYALYGGSSSEDDEHPEVPRTRRPVSGAVLSGPGPARAPPPPAGSGGAGRTPTTAPRA<br>PRTQRVATKAPAAPAAETTRGRKSAQPESAALPDAPASTAPTRSKTPAQGLARKLHFSTAPPNPD<br>APWTPRVAGFNKRVFCAAVGRLAAMHARMAAVQLWDMSRPRTDEDLNELLGITTIRVTVCEG<br>KNLLQRANELVNPDVVQDVDAATATRGRSAASRPTERPRAPARSASRPRRPVE (SEQ ID NO: 2023),<br>MTSRRSVKSGPREVPRDEYEDLYYTPSSGMASPDSPPDTSRRGALQTRSRQRGEVRFVQYDESDY |

TABLE E-continued

| C35 Epitope Analog | Exemplary Cell-Penetrating Peptide Sequence (CPP) | Exemplary Polypeptide Containing C35 Epitope Analog and CPP |
|---|---|---|
| (ILNSRPPCV, SEQ ID NO: 179) | | ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**ILNSRPPAV**MTSRRSVKSGPRE<br>VPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 2024) |
| | membrane-translocating sequence MST) from h region of the signal sequence of Kaposi fibroblast growth factor | **ILNSRPPAV**AAVLLPVLLAAP (SEQ ID NO: 2025),<br>AAVLLPVLLAAP**ILNSRPPAV**AAVLLPVLLAAP (SEQ ID NO: 2026) |
| Analog of I105-V113 of SEQ ID NO: 2 having methionine substituted for threonine at the second amino acid residue and alanine substituted for cysteine at the eighth amino acid residue (IMNSRPPCV, SEQ ID NO: 180) | HSV-1 tegument protein VP22 | **IMNSRPPAV**MTSRRSVKSGPREVPRDEYEDLYYTPSSGMASPDSPPDTSRRGALQTRSRQRGEVR<br>FVQYDESDYALYGGSSSEDDEHPEVPRTRRPVSGAVLSGPGPARAPPPPAGSGGAGRTPTTAPRA<br>PRTQRVATKAPAAPAAETTRGRKSAQPESAALPDAPASTAPTRSKTPAQGLARKLHFSTAPPNPD<br>APWTPRVAGFNKRVFCAAVGRLAAMHARMAAVQLWDMSRPRTDEDLNELLGITTIRVTVCEG<br>KNLLQRANELVNPDVVQDVDAATATRGRSAASRPTERPRAPARSASRPRRPVE (SEQ ID NO: 2027),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**IMNSRPPAV**MTSRRSVKSGPR<br>EVPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 2028) |
| | membrane-translocating sequence (MST) from h region of the signal sequence of Kaposi fibroblast growth factor | **IMNSRPPAV**AAVLLPVLLAAP (SEQ ID NO: 2029),<br>AAVLLPVLLAAP**IMNSRPPAV**AAVLLPVLLAAP (SEQ ID NO: 2030) |
| Analog of I105-V113 of SEQ ID NO: 2 having serine substituted for cysteine at the eighth amino acid residue (ITNSRPPSV, SEQ ID NO: 189) | HSV-1 tegument protein VP22 | **ITNSRPPSV**<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE (SEQ ID NO: 2031),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**ITNSRPPSV**MTSRRSVKSGPRE |

TABLE E-continued

| C35 Epitope Analog | Exemplary Cell-Penetrating Peptide Sequence (CPP) | Exemplary Polypeptide Containing C35 Epitope Analog and CPP |
|---|---|---|
| | | VPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 2032) |
| | membrane-translocating sequence (MST) from h region of the signal sequence of Kaposi fibroblast growth factor | **ITNSRPPSV**AAVLLPVLLAAP (SEQ ID NO: 2033),<br>AAVLLPVLLAAP**ITNSRPPSV**AAVLLPVLLAAP (SEQ ID NO: 2034) |
| Analog of K104-V113 of SEQ ID NO: 2 having serine substituted for cysteine at the ninth amino acid residue (KITNSRPPSV, SEQ ID NO: 178) | HSV-1 tegument protein VP22 | **KITNSRPPSV**MTSRRSVKSGPREVPRDEYEDLYYTPSSGMASPDSPPDTSRRGALQTRSRQRGEV<br>RFVQYDESDYALYGGSSSEDDEHPEVPRTRRPVSGAVLSGPGPARAPPPPAGSGGAGRTPTTAPR<br>APRTQRVATKAPAAPAAETTRGRKSAQPESAALPDAPASTAPTRSKTPAQGLARKLHFSTAPPNP<br>DAPWTPRVAGFNKRVFCAAVGRLAAMHARMAAVQLWDMSRPRTDEDLNELLGITTIRVTVCE<br>GKNLLQRANELVNPDVVQDVDAATATRGRSAASRPTERPRAPARSASRPRRPVE (SEQ ID NO: 2035),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**KITNSRPPSV**MTSRRSVKSGPR<br>EVPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 2036) |
| | membrane-translocating sequence (MST) from h region of the signal sequence of Kaposi fibroblast growth factor | **KITNSRPPSV**AAVLLPVLLAAP (SEQ ID NO: 2037),<br>AAVLLPVLLAAP**KITNSRPPSV**AAVLLPVLLAAP (SEQ ID NO: 2038) |
| Analog of G22 to C30 of SEQ ID NO: 2 having alanine substituted for cysteine at ninth amino acid residue (GVRIVVEYA, SEQ ID NO: 161) | HSV-1 tegument protein VP22 | **GVRIVVEYA**MTSRRSVKSGPREVPRDEYEDLYYTPSSGMASPDSPPDTSRRGALQTRSRQRGEV<br>RFVQYDESDYALYGGSSSEDDEHPEVPRTRRPVSGAVLSGPGPARAPPPPAGSGGAGRTPTTAPR<br>APRTQRVATKAPAAPAAETTRGRKSAQPESAALPDAPASTAPTRSKTPAQGLARKLHFSTAPPNP<br>DAPWTPRVAGFNKRVFCAAVGRLAAMHARMAAVQLWDMSRPRTDEDLNELLGITTIRVTVCE<br>GKNLLQRANELVNPDVVQDVDAATATRGRSAASRPTERPRAPARSASRPRRPVE (SEQ ID NO: 2039),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**GVRIVVEYA**MTSRRSVKSGPR<br>EVPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 2040) |

TABLE E-continued

| C35 Epitope Analog | Exemplary Cell-Penetrating Peptide Sequence (CPP) | Exemplary Polypeptide Containing C35 Epitope Analog and CPP |
|---|---|---|
| | membrane-translocating sequence (MST) from h region of the signal sequence of Kaposi fibroblast growth factor | **GVRIVVEYA**AAVLLPVLLAAP (SEQ ID NO: 2041),<br>AAVLLPVLLAAP**GVRIVVEYA**AAVLLPVLLAAP (SEQ ID NO: 2042) |
| Analog of I25 to C33 of SEQ ID NO: 2 having alanine substituted for cysteine at the sixth and ninth amino acid residues (IVVEYAEPA, SEQ ID NO: 167) | HSV-1 tegument protein VP22 | **IVVEYAEPA**MTSRRSVKSGPREVPRDEYEDLYYTPSSGMASPDSPPDTSRRGALQTRSRQRGEVR<br>FVQYDESDYALYGGSSSEDDEHPEVPRTRRPVSGAVLSGPGPARAPPPPAGSGGAGRTPTTAPRA<br>PRTQRVATKAPAAPAAETTRGRKSAQPESAALPDAPASTAPTRSKTPAQGLARKLHFSTAPPNPD<br>APWTPRVAGFNKRVFCAAVGRLAAMHARMAAVQLWDMSRPRTDEDLNELLGITTIRVTVCEG<br>KNLLQRANELVNPDVVQDVDAATATRGRSAASRPTERPRAPARSASRPRRPVE (SEQ ID NO: 2043),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**IVVEYAEPA**MTSRRSVKSGPR<br>EVPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 2044) |
| | membrane-translocating sequence (MST) from h region of the signal sequence of Kaposi fibroblast growth factor | **IVVEYAEPA**AAVLLPVLLAAP (SEQ ID NO: 2045),<br>AAVLLPVLLAAP**IVVEYAEPA**AAVLLPVLLAAP (SEQ ID NO: 2046) |
| Analog of K104-C112 of SEQ ID NO: 2 having alanine substituted for cysteine at the ninth amino acid residue (KITNSRPPA, SEQ ID NO: 173) | HSV-1 tegument protein VP22 | **KITNSRPPA**MTSRRSVKSGPREVPRDEYEDLYYTPSSGMASPDSPPDTSRRGALQTRSRQRGEVR<br>FVQYDESDYALYGGSSSEDDEHPEVPRTRRPVSGAVLSGPGPARAPPPPAGSGGAGRTPTTAPRA<br>PRTQRVATKAPAAPAAETTRGRKSAQPESAALPDAPASTAPTRSKTPAQGLARKLHFSTAPPNPD<br>APWTPRVAGFNKRVFCAAVGRLAAMHARMAAVQLWDMSRPRTDEDLNELLGITTIRVTVCEG<br>KNLLQRANELVNPDVVQDVDAATATRGRSAASRPTERPRAPARSASRPRRPVE (SEQ ID NO: 2047),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHRMAAVQLWDMSRPRTDEDLNELLGITTIRVTVCEGKNLLQRANEL<br>VNPDVVQDVDAATATRGRSAASRPTERPRAPARSASRPRRPVE**KITNSRPPA**MTSRRSVKSGPRE<br>VPRDEYEDLYYTPSSGMASPDSPPDTSRRGALQTRSRQRGEVRFVQYDESDYALYGGSSSEDDE<br>HPEVPRTRRPVSGAVLSGPGPARAPPPPAGSGGAGRTPTTAPRAPRTQRVATKAPAAPAAETTRG<br>RKSAQPESAALPDAPASTAPTRSKTPAQGLARKLHFSTAPPNPDAPWTPRVAGFNKRVFCAAVG<br>RLAAMHARMAAVQLWDMSRPRTDEDLNELLGITTIRVTVCEGKNLLQRANELVNPDVVQDVD<br>AATATRGRSAASRPTERPRAPARSASRPRRPVE (SEQ ID NO: 2048) |

TABLE E-continued

| C35 Epitope Analog | Exemplary Cell-Penetrating Peptide Sequence (CPP) | Exemplary Polypeptide Containing C35 Epitope Analog and CPP |
|---|---|---|
| | membrane-translocating sequence (MST) from h region of the signal sequence of Kaposi fibroblast growth factor | **KITNSRPPA**AAVLLPVLLAAP (SEQ ID NO: 2049),<br>AAVLLPVLLAAP **KITNSRPPA**AAVLLPVLLAAP (SEQ ID NO: 2050) |
| Analog of K104-V113 of SEQ ID NO: 2 having alanine substituted for cysteine at the ninth amino acid residue (KITNSRPPAV, SEQ ID NO: 176) | HSV-1 tegument protein VP22 | **KITNSRPPAV**MTSRRSVKSGPREVPRDEYEDLYYTPSSGMASPDSPPDTSRRGALQTRSRQRGEV<br>RFVQYDESDYALYGGSSSEDDEHPEVPRTRRPVSGAVLSGPGPARAPPPPAGSGGAGRTPTTAPR<br>APRTQRVATKAPAAPAAETTRGRKSAQPESAALPDAPASTAPTRSKTPAQGLARKLHFSTAPPNP<br>DAPWTPRVAGFNKRVFCAAVGRLAAMHARMAAVQLWDMSRPRTDEDLNELLGITTIRVTVCE<br>GKNLLQRANELVNPDVVQDVDAATATRGRSAASRPTERPRAPARSASRPRRPVE (SEQ ID NO: 2051),<br>MTSRRSVKSGPREVPRDEYEDLYYTPSSGMASPDSPPDTSRRGALQTRSRQRGEVRFVQYDESDY<br>ALYGGSSSEDDEHPEVPRTRRPVSGAVLSGPGPARAPPPPAGSGGAGRTPTTAPRAPRTQRVATK<br>APAAPAAETTRGRKSAQPESAALPDAPASTAPTRSKTPAQGLARKLHFSTAPPNPDAPWTPRVAG<br>FNKRVFCAAVGRLAAMHARMAAVQLWDMSRPRTDEDLNELLGITTIRVTVCEGKNLLQRANEL<br>VNPDVVQDVDAATATRGRSAASRPTERPRAPARSASRPRRPVE**KITNSRPPAV**MTSRRSVKSGP<br>REVPRDEYEDLYYTPSSGMASPDSPPDTSRRGALQTRSRQRGEVRFVQYDESDYALYGGSSSEDD<br>EHPEVPRTRRPVSGAVLSGPGPARAPPPPAGSGGAGRTPTTAPRAPRTQRVATKAPAAPAAETTR<br>GRKSAQPESAALPDAPASTAPTRSKTPAQGLARKLHFSTAPPNPDAPWTPRVAGFNKRVFCAAV<br>GRLAAMHARMAAVQLWDMSRPRTDEDLNELLGITTIRVTVCEGKNLLQRANELVNPDVVQDV<br>DAATATRGRSAASRPTERPRAPARSASRPRRPVE (SEQ ID NO: 2052) |
| | membrane-translocating sequence (MST) from h region of the signal sequence of Kaposi fibroblast growth factor | **KITNSRPPAV**AAVLLPVLLAAP (SEQ ID NO: 2053),<br>AAVLLPVLLAAP **KITNSRPPAV**AAVLLPVLLAAP (SEQ ID NO: 2054) |

The peptides in accordance with the invention can be a variety of lengths, and either in their neutral (uncharged) forms or in forms which are salts. The peptides in accordance with the invention can contain modifications such as glycosylation, side chain oxidation, or phosphorylation, generally subject to the condition that modifications do not destroy the biological activity of the peptides.

The peptides of the invention can be prepared in a wide variety of ways. For the preferred relatively short size, the peptides can be synthesized in solution or on a solid support in accordance with conventional techniques. Various automatic synthesizers are commercially available and can be used in accordance with known protocols. (See, for example, Stewart & Young, Solid Phase Peptide Synthesis, 2d. ed., Pierce Chemical Co., 1984). Further, individual C35 peptide epitopes and C35 peptide epitope analogs can be joined using chemical ligation to produce larger homopolymer or heteropolymer polypeptides that are still within the bounds of the invention.

Alternatively, recombinant DNA technology can be employed wherein a nucleotide sequence which encodes an immunogenic peptide of interest is inserted into an expression vector, transformed or transfected into an appropriate host cell and cultivated under conditions suitable for expression. These procedures are generally known in the art, as described generally in Sambrook et al., Molecular Cloning, a Laboratory Manual, Cold Spring Harbor Press, Cold Spring Harbor, N.Y. (1989). Thus, recombinant polypeptides, which comprise one or more peptide epitope sequences of the invention, can be used to present the appropriate T cell epitope.

The nucleotide coding sequence for C35 peptide epitopes or C35 peptide epitope analogs of the preferred lengths contemplated herein can be synthesized by chemical techniques, for example, the phosphotriester method of Matteucci, et al., *J. Am. Chem. Soc.* 103:3185 (1981). Peptide analogs can be made simply by substituting the appropriate and desired nucleic acid base(s) for those that encode the native peptide sequence; exemplary nucleic acid substitutions are those that encode an amino acid defined by the motifs/supermotifs herein. The coding sequence can then be provided with appropriate linkers and ligated into expression vectors commonly available in the art, and the vectors used to transform suitable hosts to produce the desired fusion protein. A number of such vectors and suitable host systems are now available. For expression of the fusion proteins, the coding sequence will be provided with operably linked start and stop codons, promoter and terminator regions and usually a replication system to provide an expression vector for expression in the desired cellular host. For example, promoter sequences compatible with bacterial hosts are provided in plasmids containing convenient restriction sites for insertion of the desired coding sequence. The resulting expression vectors are transformed into suitable bacterial hosts. Of course, yeast, insect or mammalian cell hosts may also be used, employing suitable vectors and control sequences.

It is generally preferable that the peptide epitope be as small as possible while still maintaining substantially all of the immunologic activity of the native protein. When possible, it may be desirable to optimize HLA class I binding peptide epitopes of the invention to a length of about 8 to about 13 amino acid residues, preferably 9 to 10. It is to be appreciated that a longer polypeptide, e.g., a C35 polypeptide fragment or a synthetic polypeptide, can comprise one or more C35 peptide epitopes or C35 peptide epitope analogs in this size range (see the Definition Section for the term "epitope" for further discussion of peptide length). HLA class II binding epitopes are preferably optimized to a length of about 6 to about 30 amino acids in length, preferably to between about 13 and about 20 residues. Preferably, the epitopes are commensurate in size with endogenously processed pathogen-derived peptides or tumor cell peptides that are bound to the relevant HLA molecules. The identification and preparation of peptides of various lengths can be carried out using the techniques described herein.

An alternative preferred embodiment of the invention comprises administration of peptides of the invention linked as a polyepitopic polypeptide, e.g., homopolymers or heteropolymers, or as a minigene that encodes a polyepitopic polypeptide.

Another preferred embodiment is obtained by identifying native C35 polypeptide regions that contain a high concentration of class I and/or class II C35 peptide epitopes. Such a sequence is generally selected on the basis that it contains the greatest number of C35 epitopes per amino acid length. It is to be appreciated that epitopes can be present in a frame-shifted manner, e.g. a 10 amino acid long peptide could contain two 9 amino acid long epitopes and one 10 amino acid long epitope; upon intracellular processing, each epitope can be exposed and bound by an HLA molecule upon administration of such a peptide. Thus a larger, preferably multi-epitopic, polypeptide can be generated synthetically, recombinantly, or via cleavage from the native source.

Assays to Detect T-Cell Responses

Once HLA binding peptides are identified, they can be tested for the ability to elicit a T-cell response. The preparation and evaluation of motif-bearing peptides are described, e.g., in PCT publications WO 94/20127 and WO 94/03205, the entire contents of which are hereby incorporated by reference. Briefly, peptides comprising epitopes from a particular antigen are synthesized and tested for their ability to bind to relevant HLA proteins. These assays may involve evaluation of peptide binding to purified HLA class I molecules in relation to the binding of a radioiodinated reference peptide. Alternatively, cells expressing empty class I molecules (i.e. cell surface HLA molecules that lack any bound peptide) may be evaluated for peptide binding by immunofluorescent staining and flow microfluorimetry. Other assays that may be used to evaluate peptide binding include peptide-dependent class I assembly assays and/or the inhibition of CTL recognition by peptide competition. Those peptides that bind to an HLA class I molecule, typically with an affinity of 500 nM or less, are further evaluated for their ability to serve as targets for CTLs derived from infected or immunized individuals, as well as for their capacity to induce primary in vitro or in vivo CTL responses that can give rise to CTL populations capable of reacting with selected target cells associated with pathology.

Analogous assays are used for evaluation of HLA class II binding peptides. HLA class II motif-bearing peptides that are shown to bind, typically at an affinity of 1000 nM or less, are further evaluated for the ability to stimulate HTL responses.

Conventional assays utilized to detect T cell responses include proliferation assays, lymphokine secretion assays, direct cytotoxicity assays, and limiting dilution assays. For example, antigen-presenting cells that have been incubated with a peptide can be assayed for the ability to induce CTL responses in responder cell populations. Antigen-presenting cells can be normal cells such as peripheral blood mononuclear cells or dendritic cells. Alternatively, mutant, non-human mammalian cell lines that have been transfected with a human class I MHC gene, and that are deficient in their ability to load class I molecules with internally processed peptides, are used to evaluate the capacity of the peptide to induce in vitro primary CTL responses. Peripheral blood mononuclear cells (PBMCs) can be used as the source of CTL precursors. Antigen presenting cells are incubated with peptide, after which the peptide-loaded antigen-presenting cells are then incubated with the responder cell population under optimized culture conditions. Positive CTL activation can be determined by assaying the culture for the presence of CTLs that lyse radio-labeled target cells, either specific peptide-pulsed targets or target cells that express endogenously processed antigen from which the specific peptide was derived. Alternatively, the presence of epitope-specific CTLs can be determined by IFNγ in situ ELISA.

Additionally, a method has been devised which allows direct quantification of antigen-specific T cells by staining with fluorescein-labelled HLA tetrameric complexes (Altman, J. D. et al., *Proc. Natl. Acad. Sci. USA* 90:10330, 1993; Altman, J. D. et al., *Science* 274:94, 1996). Other options include staining for intracellular lymphokines, and interferon release assays or ELISPOT assays. Tetramer staining, intracellular lymphokine staining and ELISPOT assays all appear to be at least 10-fold more sensitive than more conventional assays (Lalvani, A. et al., *J. Exp. Med.* 186:859, 1997; Dunbar, P. R. et al, *Curr. Biol.* 8:413, 1998; Murali-Krishna, K. et al., *Immunity* 8:177, 1998).

Helper T lymphocyte (HTL) activation may also be assessed using techniques known to those in the art, such as T cell proliferation or lymphokine secretion (see, e.g. Alexander et al., Immunity 1:751-761, 1994).

Alternatively, immunization of HLA transgenic mice can be used to determine immunogenicity of peptide epitopes. Several transgenic mouse strains, e.g., mice with human A2.1, A11 (which can additionally be used to analyze HLA-A3 epitopes), and B7 alleles have been characterized. Other transgenic mice strains (e.g., transgenic mice for HLA-A1 and A24) are being developed. Moreover, HLA-DR1 and HLA-DR3 mouse models have been developed. In accordance with principles in the art, additional transgenic mouse models with other HLA alleles are generated as necessary.

Such mice can be immunized with peptides emulsified in Incomplete Freund's Adjuvant; thereafter any resulting T cells can be tested for their capacity to recognize target cells that have been peptide-pulsed or transfected with genes encoding the peptide of interest. CTL responses can be analyzed using cytotoxicity assays described above. Similarly, HTL responses can be analyzed using, e.g., T cell proliferation or lymphokine secretion assays.

Vaccine Compositions

Vaccines that contain an immunologically effective amount of one or more C35 peptide epitopes and/or C35 peptide epitope analogs of the invention are a further embodiment of the invention. The peptides can be delivered by various means or formulations, all collectively referred to as "vaccine" compositions. Such vaccine compositions, and/or modes of administration, can include, for example, naked cDNA in cationic lipid formulations; lipopeptides (e.g., Vitiello, A. et al., *J. Clin. Invest.* 95:341, 1995), naked cDNA or peptides, encapsulated e.g., in poly(DL-lactide-co-glycolide) ("PLG") microspheres (see, e.g., Eldridge, et al., *Molec. Immunol.* 28:287-294, 1991: Alonso et al., *Vaccine* 12:299-306, 1994; Jones et al., *Vaccine* 13:675-681, 1995); peptide compositions contained in immune stimulating complexes (ISCOMS) (see, e.g., Takahashi et al., *Nature* 344:873-875, 1990; Hu et al., *Clin Exp Immunol.* 113:235-243, 1998); multiple antigen peptide systems (MAPs) (see e.g., Tam, J. P., *Proc. Natl. Acad. Sci. U.S.A.* 85:5409-5413, 1988; Tam, J. P., *J. Immunol. Methods* 196:17-32, 1996); viral, bacterial, or, fungal delivery vectors (Perkus, M. E. et al., In: *Concepts in vaccine development*, Kaufmann, S. H. E., ed., p. 379, 1996; Chakrabarti, S. et al., *Nature* 320:535, 1986; Hu, S. L. et al., *Nature* 320:537, 1986; Kieny, M.-P. et al., *AIDS Bio/Technology* 4:790, 1986; Top, F. H. et al., *J. Infect. Dis.* 124:148, 1971; Chanda, P. K. et al., *Virology* 175:535, 1990); particles of viral or synthetic origin (e.g., Kofler, N. et al., *J. Immunol. Methods.* 192:25, 1996; Eldridge, J. H. et al., *Sem. Hematol.* 30:16, 1993; Falo, L. D., Jr. et al., *Nature Med.* 7:649, 1995); adjuvants (Warren, H. S., Vogel, F. R., and Chedid, L. A. *Annu. Rev. Immunol.* 4:369, 1986; Gupta, R. K. et al., *Vaccine* 11:293, 1993); liposomes (Reddy, R. et al., *J. Immunol.* 148:1585, 1992; Rock, K. L., *Immunol. Today* 17:131, 1996); or, particle-absorbed cDNA (Ulmer, J. B. et al., *Science* 259:1745, 1993; Robinson, H. L., Hunt, L. A., and Webster, R. G., *Vaccine* 11:957, 1993; Shiver, J. W. et al., In: *Concepts in vaccine development*, Kaufmann, S. H. E., ed., p. 423, 1996; Cease, K. B., and Berzofsky, J. A., *Annu. Rev. Immunol.* 12:923, 1994 and Eldridge, J. H. et al., *Sem. Hematol.* 30:16, 1993), etc. Toxin-targeted delivery technologies, also known as receptor mediated targeting, such as those of Avant Immunotherapeutics, Inc. (Needham, Mass.) or attached to a stress protein, e.g., HSP 96 (Stressgen Biotechnologies Corp., Victoria, BC, Canada) can also be used.

Vaccines of the invention comprise nucleic acid mediated modalities. DNA or RNA encoding one or more of the polypeptides of the invention can be administered to a patient. This approach is described, for instance, in Wolff et. al., *Science* 247:1465 (1990) as well as U.S. Pat. Nos. 5,580,859; 5,589,466; 5,804,566; 5,739,118; 5,736,524; 5,679,647; and, WO 98/04720. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922,687). Accordingly, peptide vaccines of the invention can be expressed by viral or bacterial vectors. Examples of expression vectors include attenuated viral hosts, such as vaccinia or fowlpox. For example, vaccinia virus is used as a vector to express nucleotide sequences that encode the peptides of the invention. Upon introduction into an acutely or chronically infected host or into a non-infected host, the recombinant vaccinia virus expresses the immunogenic peptide, and thereby elicits an immune response. Vaccinia vectors and methods useful in immunization protocols are described in, e.g., U.S. Pat. No. 4,722,848. Another vector is BCG (Bacille Calmette Guerin). BCG vectors are described in Stover et al., *Nature* 351:456-460 (1991). A wide variety of other vectors useful for therapeutic administration or immunization of the peptides of the invention, e.g. adeno and adeno-associated virus vectors, alpha virus vectors, retroviral vectors, *Salmonella typhi* vectors, detoxified anthrax toxin vectors, and the like, are apparent to those skilled in the art from the description herein.

Furthermore, vaccines in accordance with the invention can comprise one or more C35 peptide epitopes of the invention. Accordingly, a C35 peptide epitope or C35 peptide epitope analog can be present in a vaccine individually or; alternatively, the peptide epitope or analog can exist as multiple copies of the same peptide epitope or analog (a homopolymer), or as multiple different peptide epitopes or analogs (a heteropolymer). Polymers have the advantage of increased probability for immunological reaction and, where different peptide epitopes or analogs are used to make up the polymer, the ability to induce antibodies and/or T cells that react with different antigenic determinants of the antigen targeted for an immune response. The composition may be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza virus proteins, hepatitis B virus core protein, and the like. The vaccines can contain a physiologically tolerable diluent such as water, or a saline solution, preferably phosphate buffered saline. Generally, the vaccines also include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glyceryl-cysteinyl-seryl-serine ($P_3CSS$).

Upon immunization with a peptide composition in accordance with the invention, via injection (e.g., subcutaneous, intradermal, intramuscular, aerosol, oral, transdermal, transmucosal, intrapleural, intrathecal), or other suitable routes, the immune system of the host responds to the vaccine by producing antibodies, CTLs and/or HTLs specific for the desired antigen. Consequently, the host becomes at least partially immune to subsequent exposure to the TAA, or at least partially resistant to further development of tumor associated antigen-bearing cells and thereby derives a prophylactic or therapeutic benefit.

In certain embodiments, components that induce T cell responses are combined with components that induce antibody responses to the target antigen of interest. A preferred embodiment of such a composition comprises class I and class II epitopes in accordance with the invention. Alternatively, a composition comprises a class I and/or class II epitope in accordance with the invention, along with a PADRE™ molecule (Epimmune, San Diego, Calif.).

Vaccine compositions of the invention can comprise antigen presenting cells, such as dendritic cells, as a vehicle to present peptides of the invention. For example, dendritic cells are transfected, e.g., with a minigene construct in accordance with the invention, in order to elicit immune responses. Minigenes are discussed in greater detail in a following section. Vaccine compositions can be created in vitro, following dendritic cell mobilization and harvesting, whereby loading of dendritic cells occurs in vitro.

The vaccine compositions of the invention may also be used in combination with antiviral drugs such as interferon-α, immune adjuvants such as IL-12, GM-CSF, etc.

Preferably, the following principles are utilized when selecting epitope(s) for inclusion in a vaccine, either peptide-based or nucleic acid-based formulations. Each of the following principles can be balanced in order to make the selection. When multiple epitopes are to be used in a vaccine, the epitopes may be, but need not be, contiguous in sequence in the native antigen from which the epitopes are derived.

1) Epitopes are selected which, upon administration, mimic immune responses that have been observed to be correlated with prevention or clearance of TAAexpressing tumors. For HLA Class I, this generally includes 3-4 epitopes derived from at least one TAA.

2) Epitopes are selected that have the requisite binding affinity established to be correlated with immunogenicity: for HLA Class I an $IC_{50}$ of 500 nM or less, or for Class II an $IC_{50}$ of 1000 nM or less. For HLA Class I it is presently preferred to select a peptide having an $IC_{50}$ of 200 nM or less, as this is believed to better correlate not only to induction of an immune response, but to in vitro tumor cell killing as well.

3) Supermotif bearing-peptides, or a sufficient array of allele-specific motif-bearing peptides, are selected to give broad population coverage. In general, it is preferable to have at least 80% population coverage. A Monte Carlo analysis, a statistical evaluation known in the art, can be employed to assess the breadth of population coverage.

4) When selecting epitopes from cancer-related antigens, it can be preferable to include analog peptides in the selection, because the patient may have developed tolerance to the native epitope. When selecting epitopes for infectious disease-related antigens it is presently preferable to select either native or analog epitopes.

5) Of particular relevance are "nested epitopes." Nested epitopes (or epitope analogs) occur where at least two epitopes or analogs (or an epitope and an analog) overlap in a given polypeptide sequence. A polypeptide comprising "transcendent nested epitopes" is a polypeptide that has both HLA class I and HLA class II epitopes and/or analogs in it. When providing nested epitopes, it is preferable to provide a sequence that has the greatest number of epitopes or analogs per provided sequence. Preferably, one avoids providing a polypeptide that is any longer than the combined length of the peptide epitopes or analogs. When providing a polypeptide comprising nested epitopes, it is important to evaluate the polypeptide in order to insure that it does not have pathological or other deleterious biological properties; this is particularly relevant for vaccines directed to infectious organisms. Thus, in a preferred embodiment, the vaccine compositions of the invention comprise one or more multi-epitope polypeptides selected from the group consisting of: I105 to V113 of SEQ ID NO:2 and FIG. 1B, T101 to V113 of SEQ ID NO:2 and FIG. 1B, E100 to V113 of SEQ ID NO:2 and FIG. 1B, G99 to V113 of SEQ ID NO:2 and FIG. 1B, I93 to V113 of SEQ ID NO:2 and FIG. 1B, D88 to V113 of SEQ ID NO:2 and FIG. 1B, P84 to V113 of SEQ ID NO:2 and FIG. 1B, K77 to V113 of SEQ ID NO:2 and FIG. 1B, Q72 to V113 of SEQ ID NO:2 and FIG. 1B, F65 to V113 of SEQ ID NO:2 and FIG. 1B, and L59 to V113 of SEQ ID NO:2 and FIG. 1B.

6) If a polypeptide comprising more than one C35 peptide epitope or C35 peptide epitope analog is created, or when creating a minigene, an objective is to generate the smallest polypeptide that encompasses the epitopes/analogs of interest. This principle is similar, if not the same as that employed when selecting a polypeptide comprising nested epitopes. However, with an artificial polyepitopic polypeptide, the size minimization objective is balanced against the need to integrate any spacer sequences between epitopes in the polyepitopic polypeptide. Spacer or linker amino acid residues can be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

Minigene Vaccines

A number of different approaches are available which allow simultaneous delivery of multiple epitopes. Nucleic acids encoding multiple C35 peptide epitopes or analogs are a useful embodiment of the invention; discrete epitopes/analogs or polyepitopic polypeptides can be encoded. The epitopes or analogs to be included in a minigene are preferably selected according to the guidelines set forth in the previous section. Examples of amino acid sequences that can be included in a minigene include: HLA class I epitopes or analogs, HLA class II epitopes or analogs, a ubiquitination signal sequence, and/or a targeting sequence such as an endoplasmic reticulum (ER) signal sequence to facilitate movement of the resulting peptide into the endoplasmic reticulum.

The use of multi-epitope minigenes is also described in, e.g., Ishioka et al., *J. Immunol.* 162:3915-3925, 1999; An, L. and Whitton, J. L., *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. A similar approach can be used to develop minigenes encoding TAA epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. However, to optimize expression and/or immunogenicity, additional elements can be incorporated into the minigene design such as one or more spacer or linker amino acid residues between epitopes. HLA presentation of CTL and HTL epitopes may be improved by including synthetic (e.g. polyalanine) or naturally-occurring flanking sequences adjacent to the CTL or HTL epitopes; these larger polypeptides comprising the epitope(s)/analog(s) are within the scope of the invention.

The minigene sequence may be converted to DNA by assembling oligonucleotides that encode the plus and minus strands of the minigene. Overlapping oligonucleotides (30-100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a downstream cloning site for minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Optimized peptide expression and immunogenicity can be achieved by certain modifications to a minigene construct. For example, in some cases introns facilitate efficient gene expression, thus one or more synthetic or naturally-occurring introns can be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate bacterial strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as cell banks.

In addition, immunostimulatory sequences (ISSs or CpGs) appear to play a role in the immunogenicity of DNA vaccines. These sequences may be included in the vector, outside the minigene coding sequence to enhance immunogenicity.

In some embodiments, a bi-cistronic expression vector which allows production of both the minigene-encoded epitopes and a second protein (e.g., one that modulates immunogenicity) can be used. Examples of proteins or polypeptides that, if co-expressed with epitopes, can enhance an immune response include cytokines (e.g., IL-2, IL-12, GMCSF), cytokine-inducing molecules (e.g., LeIF), costimulatory molecules, or pan-DR binding proteins (PADRE™, Epimmune, San Diego, Calif.). Helper T cell (HTL) epitopes such as PADRE™ molecules can be joined to intracellular targeting signals and expressed separately from expressed CTL epitopes. This can be done in order to direct HTL epitopes to a cell compartment different than that of the CTL epitopes, one that provides for more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in *E. coli*, followed by purification. Aliquots from the working cell bank are used to inoculate growth medium, and are grown to saturation in shaker flasks or a bioreactor according to well known techniques. Plasmid DNA is purified using standard bioseparation technologies such as solid phase anion-exchange resins available, e.g., from QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene vaccines, alternative methods of formulating purified plasmid DNA may be used. A variety of such methods have been described, and new techniques may become available. Cationic lipids, glycolipids, and fusogenic liposomes can also be used in the formulation (see, e.g., WO 93/24640; Mannino & Gould-Fogerite, *BioTechniques* 6(7): 682 (1988); U.S. Pat. No. 5,279,833; WO 91/06309; and Felgner, et al., *Proc. Nat'l Acad. Sci. USA* 84:7413 (1987). In addition, peptides and compounds referred to collectively as protective, interactive, non-condensing compounds (PINC) can also be complexed to purified plasmid DNA to influence variables such as stability, intramuscular dispersion, or trafficking to specific organs or cell types.

Target cell sensitization can be used as a functional assay of the expression and HLA class I presentation of minigene-encoded epitopes. For example, the plasmid DNA is introduced into a mammalian cell line that is a suitable target for standard CTL chromium release assays. The transfection method used will be dependent on the final formulation, electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). The transfected cells are then chromium-51 ($^{51}Cr$) labeled and used as targets for epitope-specific CTLs. Cytolysis of the target cells, detected by $^{51}Cr$ release, indicates both the production and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (IP) for lipid-complexed DNA). Eleven to twenty-one days after immunization, splenocytes are harvested and restimulated for one week in the presence of peptides encoding each epitope being tested. Thereafter, for CTLs, standard assays are conducted to determine if there is cytolysis of peptide-loaded, $^{51}$Cr-labeled target cells. Once again, lysis of target cells that were exposed to epitopes corresponding to those in the minigene, demonstrates DNA vaccine function and induction of CTLs. Immunogenicity of HTL epitopes is evaluated in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment for ballistic delivery, DNA can be adhered to particles, such as gold particles.

Combinations of CTL Peptides with Helper Peptides

Vaccine compositions comprising CTL peptides of the present invention can be modified to provide desired attributes, such as improved serum half-life, broadened population coverage or enhanced immunogenicity.

For instance, the ability of a peptide to induce CTL activity can be enhanced by linking the CTL peptide to a sequence which contains at least one HTL epitope.

Although a CTL peptide can be directly linked to a T helper peptide, particularly preferred CTL epitope/HTL epitope conjugates are linked by a spacer molecule. The spacer is typically comprised of relatively small, neutral molecules, e.g., amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optional spacer need not be comprised of the same residues and thus may be a hetero- or homo-oligomer. When present, the spacer will usually be at least one or two residues, commonly three to 13, more frequently three to six residues. The CTL peptide epitope may be linked to the T helper peptide epitope, directly or via a spacer, at either it's amino or carboxyl terminus. The amino terminus of either the CTL peptide or the HTL peptide can be acylated.

In certain embodiments, the T helper peptide is one that is recognized by T helper cells present in the majority of the population. This can be accomplished by selecting amino acid sequences that bind to many, most, or all of the HLA class II molecules. These are known as "loosely HLA-restricted" or "promiscuous" T helper sequences. Examples of amino acid sequences that are promiscuous include sequences from antigens such as tetanus toxoid at positions 830-843 (QYIKANSKFIGITE (SEQ ID NO:2055)), *Plasmodium falciparum* CS protein at positions 378-398 (DIEKKIAKMEKASSVFNVVNS (SEQ ID NO:2056)), and *Streptococcus* 18 kD protein at positions 116 (GAVDSILGGVATYGAA (SEQ ID NO:2057)). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences that may not be found in nature. Synthetic compounds fall within the family of molecules called Pan-DR-binding epitopes (e.g., PADRE™, Epimmune Inc., San Diego, Calif.). PADRE™ peptides are designed to bind multiple HLA-DR (human HLA class II) molecules. For instance, a pan-DR-binding epitope peptide having the formula: aKXVAAZTLKAAa (SEQ ID NO:2058), where "X" is either cyclohexylalanine, phenylalanine, or tyrosine; "Z" is either tryptophan, tyrosine, histidine or asparagine; and "a" is either D-alanine or L-alanine, has been found to bind to numerous allele-specific HLA-DR molecules. Accordingly, these molecules stimulate a T helper lymphocyte response from most individuals, regardless of their HLA type. Certain pan-DR binding epitopes comprise all "L" natural amino acids; these molecules can be provided as peptides or in the form of nucleic acids that encode the peptide.

HTL peptide epitopes can be modified to alter their biological properties. HTL peptide epitopes can be modified in the same manner as CTL peptides. For instance, they may be modified to include D-amino acids or be conjugated to other molecules such as lipids, proteins, sugars and the like. Peptides comprising D-amino acids generally have increased resistance to proteases, and thus have an extended serum half-life.

In addition, polypeptides comprising one or more peptide epitopes of the invention can be conjugated to other molecules such as lipids, proteins or sugars, or any other synthetic compounds, to increase their biological activity. For example, a T helper peptide can be conjugated to one or more palmitic acid chains at either the amino or the carboxyl termini.

Combinations of CTL Peptides with T Cell Priming Materials

In some embodiments it may be desirable to include in the pharmaceutical compositions of the invention at least one component which primes cytotoxic T lymphocytes. Lipids have been identified as agents capable of facilitating the priming in vitro CTL response against viral antigens. For example, palmitic acid residues can be attached to the $\epsilon$- and $\alpha$-amino groups of a lysine residue and then linked to an immunogenic peptide. One or more linking moieties can be used such as Gly, Gly-Gly-, Ser, Ser-Ser, or the like. The lipidated peptide can then be administered directly in a micelle or particle, incorporated into a liposome, or emulsified in an adjuvant, e.g., incomplete Freund's adjuvant. A preferred immunogenic composition comprises palmitic acid attached to $\epsilon$- and $\alpha$-amino groups of Lys via a linking moiety, e.g., Ser-Ser, added to the amino terminus of an immunogenic peptide.

In another embodiment of lipid-facilitated priming of CTL responses, *E. coli* lipoproteins, such as tripalmitoyl-S-glycerylcysteinyl-seryl-serine ($P_3CSS$) can be used to prime CTL when covalently attached to an appropriate peptide. (See, e.g., Deres, et al., *Nature* 342:561, 1989). Thus, peptides of the invention can be coupled to $P_3CSS$, and the lipopeptide administered to an individual to specifically prime a CTL response to the target antigen. Moreover, because the induction of neutralizing antibodies can also be primed with $P_3CSS$-conjugated epitopes, two such compositions can be combined to elicit both humoral and cell-mediated responses.

Vaccine Compositions Comprising Dendritic Cells Pulsed with CTL and/or HTL Peptides An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as PROGENIPOIETIN™ (Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes in HLA molecules on their surfaces.

The DC can be pulsed ex vivo with a cocktail of peptides, some of which stimulate CTL responses to one or more antigens of interest, e.g., tumor associated antigens (TAA) such as HER2/neu, p53, MAGE 2, MAGE3, and/or carcinoembryonic antigen (CEA). Collectively, these TAA are associated with breast, colon and lung cancers. Optionally, a helper T cell (HTL) peptide such as PADRE™, can be included to facilitate the CTL response. Thus, a vaccine in accordance with the invention comprising epitopes from HER2/neu, p53, MAGE2, MAGE3, and carcinoembryonic antigen (CEA) is used to treat minimal or residual disease in patients with malignancies such as breast, colon or lung cancer; any malignancies that bear any of these TAAs can also be treated with the vaccine. A TAA vaccine can be used following debulking procedures such as surgery, radiation therapy or chemotherapy, whereupon the vaccine provides the benefit of increasing disease free survival and overall survival in the recipients.

Thus, in preferred embodiments, a vaccine of the invention is a product that treats a majority of patients across a number of different tumor types. A vaccine comprising a plurality of epitopes, preferably supermotif-bearing epitopes, offers such an advantage.

Administration of Vaccines for Therapeutic or Prophylactic Purposes

The polypeptides comprising one or more peptide epitopes of the present invention, including pharmaceutical and vaccine compositions thereof, are useful for administration to mammals, particularly humans, to treat and/or prevent disease. In one embodiment, vaccine compositions (peptide or nucleic acid) of the invention are administered to a patient who has a malignancy associated with expression of one or more TAAs, or to an individual susceptible to, or otherwise at risk for developing TAA-related disease. Upon administration an immune response is elicited against the TAAs, thereby enhancing the patient's own immune response capabilities. In therapeutic applications, peptide and/or nucleic acid compositions are administered to a patient in an amount sufficient to elicit an effective immune response to the TAA-expressing cells and to thereby cure, arrest or slow symptoms and/or complications. An amount adequate to accomplish this is defined as "therapeutically effective dose." Amounts effective for this use will depend on, e.g. the particular composition administered, the manner of administration, the stage and severity of the disease being treated, the weight and general state of health of the patient, and the judgment of the prescribing physician.

The vaccine compositions of the invention can be used purely as prophylactic agents. Generally the dosage for an initial prophylactic immunization generally occurs in a unit dosage range where the lower value is about 1, 5, 50, 500, or 1000 μg of peptide and the higher value is about 10,000; 20,000; 30,000; or 50,000 μg of peptide. Dosage values for a human typically range from about 500 μg to about 50,000 μg of peptide per 70 kilogram patient. This is followed by boosting dosages of between about 1.0 μg to about 50,000 μg of peptide, administered at defined intervals from about four weeks to six months after the initial administration of vaccine. The immunogenicity of the vaccine may be assessed by measuring the specific activity of CTL and HTL obtained from a sample of the patient's blood.

As noted above, polypeptides comprising CTL and/or HTL epitopes of the invention induce immune responses when presented by HLA molecules and contacted with a CTL or HTL specific for an epitope comprised by the peptide. The manner in which the peptide is contacted with the CTL or HTL is not critical to the invention. For instance, the peptide can be contacted with the CTL or HTL either in vitro or in vivo. If the contacting occurs in vivo, peptide can be administered directly, or in other forms/vehicles, e.g., DNA vectors encoding one or more peptides, viral vectors encoding the peptide(s), liposomes, antigen presenting cells such as dendritic cells, and the like, as described herein.

Accordingly, for pharmaceutical compositions of the invention in the form of peptides or polypeptides, the peptides or polypeptides can be administered directly. Alternatively, the peptide/polypeptides can be administered indirectly presented on APCs, or as DNA encoding them. Furthermore, the polypeptides, peptide epitopes or DNA encoding them can be administered individually or as fusions of one or more peptide sequences.

For therapeutic use, administration should generally begin at the first diagnosis of TAA-related disease. This is followed by boosting doses at least until symptoms are substantially abated and for a period thereafter. In chronic disease states, loading doses followed by boosting doses may be required.

The dosage for an initial therapeutic immunization generally occurs in a unit dosage range where the lower value is about 1, 5, 50, 500, or 1,000 μg of peptide and the higher value is about 10,000; 20,000; 30,000; or 50,000 μg of peptide. Dosage values for a human typically range from about 500 μg to about 50,000 μg of peptide per 70 kilogram patient. Boosting dosages of between about 1.0 μg to about 50,000 μg of peptide, administered pursuant to a boosting regimen over weeks to months, can be administered depending upon the patient's response and condition. Patient response can be determined by measuring the specific activity of CTL and HTL obtained from the patient's blood.

In certain embodiments, polypeptides, peptides and compositions of the present invention are used in serious disease states. In such cases, as a result of the minimal amounts of extraneous substances and the relative nontoxic nature of the peptides, it is possible and may be desirable to administer substantial excesses of these peptide compositions relative to these stated dosage amounts.

For treatment of chronic disease, a representative dose is in the range disclosed above, namely where the lower value is about 1, 5, 50, 500, or 1,000 μg of peptide and the higher value is about 10,000; 20,000; 30,000; or 50,000 μg of peptide, preferably from about 500 μg to about 50,000 μg of peptide per 70 kilogram patient. Initial doses followed by boosting doses at established intervals, e.g., from four weeks to six months, may be required, possibly for a prolonged period of time to effectively immunize an individual. In the case of chronic disease, administration should continue until at least clinical symptoms or laboratory tests indicate that the disease has been eliminated or substantially abated, and for a follow-up period thereafter. The dosages, routes of administration, and dose schedules are adjusted in accordance with methodologies known in the art.

The pharmaceutical compositions for therapeutic treatment are intended for parenteral, topical, oral, intrathecal, or local administration. Preferably, the pharmaceutical compositions are administered parentally, e.g., intravenously, subcutaneously, intradermally, or intramuscularly.

Thus, in a preferred embodiment the invention provides compositions for parenteral administration which comprise a solution of the immunogenic peptides dissolved or suspended in an acceptable carrier, preferably an aqueous carrier. A variety of aqueous carriers may be used, e.g., water, buffered water, 0.8% saline, 0.3% glycine, hyaluronic acid and the like. These compositions may be sterilized by conventional, well known sterilization techniques, or may be sterile filtered. The resulting aqueous solutions may be packaged for use as is, or lyophilized, the lyophilized preparation being combined with a sterile solution prior to administration. The compositions may contain pharmaceutically acceptable auxiliary substances or pharmaceutical excipients as may be required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides and polypeptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of the peptide and polypeptide composition is typically included in a pharmaceutical composition that also comprises a human unit dose of an acceptable carrier, preferably an aqueous carrier, and is administered in a volume of fluid that is known by those of skill in the art to be used for administration of such compositions to humans (see, e.g., *Remington's Pharmaceutical Sciences,* $17^{th}$ Edition, A. Gennaro, Editor, Mack Publishing Co., Easton, Pa., 1985).

The peptides and polypeptides of the invention can also be administered via liposomes, which serve to target the peptides and polypeptides to a particular tissue, such as lymphoid tissue, or to target selectively to infected cells, as well as to increase the half-life of the peptide composition. Liposomes include emulsions, foams, micelles, insoluble monolayers, liquid crystals, phospholipid dispersions, lamellar layers and the like. In these preparations, the peptides and polypeptides to be delivered is incorporated as part of a liposome, alone or in conjunction with a molecule which binds to a receptor prevalent among lymphoid cells (such as monoclonal antibodies which bind to the CD45 antigen) or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al., *Ann. Rev. Biophys. Bioeng.* 9:467 (1980), and U.S. Pat. Nos. 4,235,871, 4,501,728, 4,837,028, and 5,019,369.

For targeting compositions of the invention to cells of the immune system, a ligand can be incorporated into the liposome, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, often at a concentration of 25%-75%.

For aerosol administration, the immunogenic peptides are preferably supplied in finely divided form, along with a surfactant and propellant. Typical percentages of peptides are 0.01%-20% by weight, often 1%-10%. The surfactant must, of course, be pharmaceutically acceptable, and preferably soluble in the propellant. Representative of such agents are the esters or partial esters of fatty acids containing from 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute 0.1%-20% by weight of the composition, preferably 0.25-5%. The balance of the composition is ordinarily propellant, although an atomizer may be used in which no propellant is necessary and other percentages are adjusted accordingly. A carrier can also be included, e.g., lecithin for intranasal delivery.

Antigenic peptides of the invention have been used to elicit a CTL and/or HTL response ex vivo, as well. The resulting CTLs or HTLs can be used to treat chronic infections, or tumors in patients that do not respond to other conventional forms of therapy, or who do not respond to a therapeutic peptide or nucleic acid vaccine in accordance with the invention. Ex vivo CTL or HTL responses to a particular antigen (infectious or tumor-associated) are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7-28 days), in which the precursor cells are activated and expanded into effector cells, the cells are infused back into the patient, where they will destroy (CTL) or facilitate destruction (HTL) of their specific target cell (an infected cell or a tumor cell).

A number of computer algorithms have been described for identification of peptides in a larger protein that satisfy the requirements of peptide binding motifs for specific MHC class I or MHC class II molecules. Because of the extensive polymorphism of MHC molecules, different peptides will often bind to different MHC molecules. Tables 1-6 list C35 peptides predicted to be MHC binding peptides using three different algorithms. Specifically, Tables 1 and 5 list C35 HLA Class I and II epitopes predicted using the rules found at the SYFPEITHI website (wysiwyg://35/http://134.2.96.221/scripts/hlaserver.dll/EpPredict.htm) and are based on the book "MHC Ligands and Peptide Motifs" by Rammensee, H. G., Bachmann, J. and Stevanovic, S. (Chapman & Hall, New York 1997). Table 2 lists predicted MHC binding peptides derived from the C35 sequence using the NIH BIMAS program available on the web (bimas.dcrt.nih.gov/cgi-bin/molbio/ken_parker_comboform). Finally, Tables 3 and 6 list predicted C35 peptides identified by the Tepitope program, a program for prediction of peptides that may bind to multiple different MHC class II molecules. Using Tepitope, four C35 peptides were identified as likely candidates for binding to a variety of HLA class II molecules. These peptides are, in general, longer than those binding to HLA class I and more degenerate in terms of binding to multiple HLA class II molecules. Due to the relatedness of the HLA molecules and the inherent limitations of the binding algorithms, it is expected that many of these C35 peptide epitopes predicted to bind to a specific HLA molecules will also bind to one or more other HLA molecules.

TABLE 1

C35 peptides predicted by SYFPEITHI website (score reflects ligation strength):

Class I MHC HLA-A*0201 nonamers SEQ ID NO: 2

| Start Position ("Pos") | 1 2 | 3 4 | 5 6 | 7 8 | 9 | Score |
|---|---|---|---|---|---|---|
| 9 | S V | A P | P P | E E | V | 23 |
| 88 | D L | I E | A I | R R | A | 21 |
| 37 | A T | Y L | E L | A S | A | 19 |
| 97 | S N | G E | T L | E K | I | 18 |
| 105 | I T | N S | R P | P C | V | 18 |
| 2 | S G | E P | G Q | T S | V | 17 |
| 45 | A V | K E | Q Y | P G | I | 17 |
| 38 | T Y | L E | L A | S A | V | 16 |
| 61 | G T | G A | F E | I E | I | 16 |
| 85 | Y E | K D | L I | E A | I | 16 |
| 65 | F E | I E | I N | G Q | L | 15 |
| 107 | N S | R P | P C | V I | L | 15 |
| 41 | E L | A S | A V | K E | Q | 14 |
| 58 | R L | G G | T G | A F | E | 14 |
| 59 | L G | G T | G A | F E | I | 14 |
| 66 | E I | E I | N G | Q L | V | 14 |
| 68 | E I | N G | Q L | V F | S | 14 |
| 81 | G G | F P | Y E | K D | L | 14 |
| 94 | R R | A S | N G | E T | L | 14 |

HLA-A*0201 decamers

| Pos | 1 2 | 3 4 | 5 6 | 7 8 | 9 0 | Score |
|---|---|---|---|---|---|---|
| 58 | R L | G G | T G | A F | E I | 22 |
| 96 | A S | N G | E T | L E | K I | 19 |
| 104 | K I | T N | S R | P P | C V | 19 |
| 37 | A T | Y L | E L | A S | A V | 18 |
| 17 | V E | P G | S G | V R | I V | 17 |
| 33 | C G | F E | A T | Y L | E L | 16 |
| 44 | S A | V K | E Q | Y P | G I | 16 |
| 92 | A I | R R | A S | N G | E T | 16 |
| 39 | Y L | E L | A S | A V | K E | 15 |
| 53 | I E | I E | S R | L G | G T | 15 |
| 65 | F E | I E | I N | G Q | L V | 15 |
| 105 | I T | N S | R P | P C | V I | 15 |
| 1 | M S | G E | P G | Q T | S V | 14 |

TABLE 1-continued

C35 peptides predicted by SYFPEITHI website (score reflects ligation strength):

| | | | | | | |
|---|---|---|---|---|---|---|
| 63 | G A | F E | I E | I N | G Q | 14 |
| 68 | E I | N G | Q L | V F | S K | 14 |
| 69 | I N | G Q | L V | F S | K L | 14 |
| 83 | F P | Y E | K D | L I | E A | 14 |
| 88 | D L | I E | A I | R R | A S | 14 |
| 93 | I R | R A | S N | G E | T L | 14 |
| 72 | Q L | V F | S K | L E | N G | 13 |
| 89 | L I | E A | I R | R A | S N | 13 |
| 8 | T S | V A | P P | P E | E V | 12 |
| 16 | E V | E P | G S | G V | R I | 12 |
| 50 | Y P | G I | E I | E S | R L | 12 |
| 60 | G G | T G | A F | E I | E I | 12 |
| 81 | G G | F P | Y E | K D | L I | 12 |
| 106 | T N | S R | P P | C V | I L | 12 |

HLA-A*0203 nonamers

| Pos | 1 2 | 3 4 | 5 6 | 7 8 | 9 | Score |
|---|---|---|---|---|---|---|
| 35 | F E | A T | Y L | E L | A | 12 |

HLA-A*0203 decamers

| Pos | 1 2 | 3 4 | 5 6 | 7 8 | 9 0 | Score |
|---|---|---|---|---|---|---|
| 36 | E A | T Y | L E | L A | S A | 18 |

HLA-A1 nonamers

| Pos | 1 2 | 3 4 | 5 6 | 7 8 | 9 | Score |
|---|---|---|---|---|---|---|
| 77 | K L | E N | G G | F P | Y | 29 |
| 2 | S G | E P | G Q | T S | V | 18 |
| 21 | S G | V R | I V | V E | Y | 18 |
| 16 | E V | E P | G S | G V | R | 17 |
| 29 | Y C | E P | C G | F E | A | 17 |
| 42 | L A | S A | V K | E Q | Y | 17 |
| 31 | E P | C G | F E | A T | Y | 16 |
| 34 | G F | E A | T Y | L E | L | 16 |
| 39 | Y L | E L | A S | A V | K | 14 |
| 84 | P Y | E K | D L | I E | A | 14 |
| 66 | E I | E I | N G | Q L | V | 13 |
| 13 | P P | E E | V E | P G | S | 12 |
| 46 | V K | E Q | Y P | G I | E | 12 |

TABLE 1-continued

| C35 peptides predicted by SYFPEITHI website (score reflects ligation strength): | | | | | | |
|---|---|---|---|---|---|---|
| 52 | G I | E I | E S | R L | G | 12 |
| 96 | A S | N G | E T | L E | K | 12 |
| **HLA-A1 decamers** | | | | | | |
| Pos | 1 2 | 3 4 | 5 6 | 7 8 | 9 0 | Score |
| 20 | G S | G V | R I | V V | E Y | 20 |
| 29 | Y C | E P | C G | F E | A T | 19 |
| 76 | S K | L E | N G | G F | P Y | 18 |
| 2 | S G | E P | G Q | T S | V A | 17 |
| 52 | G I | E I | E S | R L | G G | 17 |
| 66 | E I | E I | N G | Q L | V F | 17 |
| 41 | E L | A S | A V | K E | Q Y | 16 |
| 46 | V K | E Q | Y P | G I | E I | 16 |
| 16 | E V | E P | G S | G V | R I | 15 |
| 30 | C E | P C | G F | E A | T Y | 15 |
| 39 | Y L | E L | A S | A V | K E | 15 |
| 77 | K L | E N | G G | F P | Y E | 14 |
| 86 | E K | D L | I E | A I | R R | 14 |
| 98 | N G | E T | L E | K I | T N | 14 |
| 34 | G F | E A | T Y | L E | L A | 12 |
| 64 | A F | E I | E I | N G | Q L | 12 |
| 101 | T L | E K | I T | N S | R P | 12 |
| **HLA-A26 nonamers** | | | | | | |
| Pos | 1 2 | 3 4 | 5 6 | 7 8 | 9 | Score |
| 68 | E I | N G | Q L | V F | S | 24 |
| 100 | E T | L E | K I | T N | S | 24 |
| 88 | D L | I E | A I | R R | A | 23 |
| 54 | E I | E S | R L | G G | T | 22 |
| 41 | E L | A S | A V | K E | Q | 21 |
| 45 | A V | K E | Q Y | P G | I | 20 |
| 31 | E P | C G | F E | A T | Y | 19 |
| 34 | G F | E A | T Y | L E | L | 19 |
| 73 | L V | F S | K L | E N | G | 19 |
| 16 | E V | E P | G S | G V | R | 18 |
| 77 | K L | E N | G G | F P | Y | 18 |
| 66 | E I | E I | N G | Q L | V | 17 |
| 21 | S G | V R | I V | V E | Y | 16 |
| 37 | A T | Y L | E L | A S | A | 16 |
| 24 | R I | V V | E Y | C E | P | 15 |
| 9 | S V | A P | P P | E E | V | 14 |

TABLE 1-continued

| C35 peptides predicted by SYFPEITHI website (score reflects ligation strength): | | | | | | |
|---|---|---|---|---|---|---|
| 22 | G V | R I | V V | E Y | C | 14 |
| 51 | P G | I E | I E | S R | L | 14 |
| 70 | N G | Q L | V F | S K | L | 14 |
| 57 | S R | L G | G T | G A | F | 13 |
| 65 | F E | I E | I N | G Q | L | 13 |
| 25 | I V | V E | Y C | E P | C | 12 |
| 48 | E Q | Y P | G I | E I | E | 12 |
| 67 | I E | I N | G Q | L V | F | 12 |
| 75 | F S | K L | E N | G G | F | 12 |
| 81 | G G | F P | Y E | K D | L | 12 |
| 104 | K I | T N | S R | P P | C | 12 |
| 105 | I T | N S | R P | P C | V | 12 |
| **HLA-A26 decamers** | | | | | | |
| Pos | 1 2 | 3 4 | 5 6 | 7 8 | 9 0 | Score |
| 41 | E L | A S | A V | K E | Q Y | 27 |
| 66 | E I | E I | N G | Q L | V F | 26 |
| 68 | E I | N G | Q L | V F | S K | 23 |
| 26 | V V | E Y | C E | P C | G F | 21 |
| 16 | E V | E P | G S | G V | R I | 20 |
| 88 | D L | I E | A I | R R | A S | 19 |
| 100 | E T | L E | K I | T N | S R | 19 |
| 74 | V F | S K | L E | N G | G F | 18 |
| 33 | C G | F E | A T | Y L | E L | 17 |
| 54 | E I | E S | R L | G G | T G | 17 |
| 56 | E S | R L | G G | T G | A F | 17 |
| 20 | G S | G V | R I | V V | E Y | 16 |
| 31 | E P | C G | F E | A T | Y L | 16 |
| 64 | A F | E I | E I | N G | Q L | 15 |
| 69 | I N | G Q | L V | F S | K L | 15 |
| 61 | G T | G A | F E | I E | I N | 14 |
| 73 | L V | F S | K L | E N | G G | 14 |
| 9 | S V | A P | P P | E E | V E | 13 |
| 25 | I V | V E | Y C | E P | C G | 13 |
| 45 | A V | K E | Q Y | P G | I E | 13 |
| 72 | Q L | V F | S K | L E | N G | 13 |
| 77 | K L | E N | G G | F P | Y E | 13 |
| 79 | E N | G G | F P | Y E | K D | 13 |
| 4 | E P | G Q | T S | V A | P P | 12 |

TABLE 1-continued

| C35 peptides predicted by SYFPEITHI website (score reflects ligation strength): | | |
|---|---|---|
| 7 | QT SV AP PP EE | 12 |
| 30 | CE PC GF EA TY | 12 |
| 36 | EA TY LE LA SA | 12 |
| 37 | AT YL EL AS AV | 12 |
| 76 | SK LE NG GF PY | 12 |
| 89 | LI EA IR RA SN | 12 |
| HLA-A3 nonamers | | |
| Pos | 12 34 56 78 9 | Score |
| 39 | YL EL AS AV K | 28 |
| 77 | KL EN GG FP Y | 25 |
| 16 | EV EP GS GV R | 24 |
| 58 | RL GG TG AF E | 22 |
| 67 | IE IN GQ LV F | 19 |
| 96 | AS NG ET LE K | 18 |
| 92 | AI RR AS NG E | 17 |
| 9 | SV AP PP EE V | 16 |
| 101 | TL EK IT NS R | 16 |
| 22 | GV RI VV EY C | 15 |
| 31 | EP CG FE AT Y | 15 |
| 45 | AV KE QY PG I | 15 |
| 72 | QL VF SK LE N | 15 |
| 21 | SG VR IV VE Y | 14 |
| 68 | EI NG QL VF S | 14 |
| 69 | IN GQ LV FS K | 14 |
| 88 | DL IE AI RR A | 14 |
| 91 | EA IR RA SN G | 14 |
| 25 | IV VE YC EP C | 13 |
| 37 | AT YL EL AS A | 13 |
| 55 | IE SR LG GT G | 13 |
| 57 | SR LG GT GA F | 13 |
| 79 | EN GG FP YE K | 13 |
| 87 | KD LI EA IR R | 13 |
| 104 | KI TN SR PP C | 13 |
| 24 | RI VV EY CE P | 12 |
| 42 | LA SA VK EQ Y | 12 |
| 66 | EI EI NG QL V | 12 |
| 89 | LI EA IR RA S | 12 |

TABLE 1-continued

| C35 peptides predicted by SYFPEITHI website (score reflects ligation strength): | | |
|---|---|---|
| 90 | IE AI RR AS N | 12 |
| 94 | RR AS NG ET L | 12 |
| HLA-A3 decamers | | |
| Pos | 12 34 56 78 90 | Score |
| 68 | EI NG QL VF SK | 22 |
| 16 | EV EP GS GV RI | 20 |
| 38 | TY LE LA SA VK | 20 |
| 41 | EL AS AV KE QY | 20 |
| 66 | EI EI NG QL VF | 20 |
| 9 | SV AP PP EE VE | 19 |
| 58 | RL GG TG AF EI | 19 |
| 39 | YL EL AS AV KE | 18 |
| 92 | AI RR AS NG ET | 18 |
| 95 | RA SN GE TL EK | 18 |
| 45 | AV KE QY PG IE | 17 |
| 54 | EI ES RL GG TG | 16 |
| 88 | DL IE AI RR AS | 16 |
| 89 | LI EA IR RA SN | 16 |
| 26 | VV EY CE PC GF | 15 |
| 37 | AT YL EL AS AV | 15 |
| 22 | GV RI VV EY CE | 14 |
| 77 | KL EN GG FP YE | 14 |
| 93 | IR RA SN GE TL | 14 |
| 25 | IV VE YC EP CG | 13 |
| 30 | CE PC GF EA TY | 13 |
| 52 | GI EI ES RL GG | 13 |
| 76 | SK LE NG GF PY | 13 |
| 78 | LE NG GF PY EK | 13 |
| 101 | TL EK IT NS RP | 13 |
| 104 | KI TN SR PP CV | 13 |
| 24 | RI VV EY CE PC | 12 |
| 72 | QL VF SK LE NG | 12 |
| HLA-B*0702 nonamers | | |
| Pos | 12 34 56 78 9 | Score |
| 18 | EP GS GV RI V | 19 |
| 107 | NS RP PC VI L | 18 |
| 4 | EP GQ TS VA P | 15 |
| 11 | AP PP EE VE P | 15 |

TABLE 1-continued

C35 peptides predicted by SYFPEITHI website (score reflects ligation strength):

| | | | | | | |
|---|---|---|---|---|---|---|
| 31 | E P | C G | F E | A T | Y | 14 |
| 34 | G F | E A | T Y | L E | L | 13 |
| 94 | R R | A S | N G | E T | L | 13 |
| 12 | P P | P E | E V | E P | G | 12 |
| 19 | P G | S G | V R | I V | V | 12 |
| 32 | P C | G F | E A | T Y | L | 12 |
| 83 | F P | Y E | K D | L I | E | 12 |
| 106 | T N | S R | P P | C V | I | 12 |

HLA-B*0702 decamers

| Pos | 1 2 | 3 4 | 5 6 | 7 8 | 9 0 | Score |
|---|---|---|---|---|---|---|
| 31 | E P | C G | F E | A T | Y L | 24 |
| 50 | Y P | G I | E I | E S | R L | 21 |
| 18 | E P | G S | G V | R I | V V | 20 |
| 83 | F P | Y E | K D | L I | E A | 16 |
| 4 | E P | G Q | T S | V A | P P | 15 |
| 11 | A P | P P | E E | V E | P G | 15 |
| 93 | I R | R A | S N | G E | T L | 14 |
| 106 | T N | S R | P P | C V | I L | 14 |
| 69 | I N | G Q | L V | F S | K L | 13 |
| 33 | C G | F E | A T | Y L | E L | 12 |
| 64 | A F | E I | E I | N G | Q L | 12 |

HLA-B*08 octamers

| Pos | 1 2 | 3 4 | 5 6 | 7 8 | Score |
|---|---|---|---|---|---|
| 83 | F P | Y E | K D | L I | 25 |
| 66 | E I | E I | N G | Q L | 16 |
| 52 | G I | E I | E S | R L | 15 |
| 18 | E P | G S | G V | R I | 14 |
| 54 | E I | E S | R L | G G | 14 |
| 91 | E A | I R | R A | S N | 14 |
| 95 | R A | S N | G E | T L | 14 |
| 100 | E T | L E | K I | T N | 14 |
| 33 | C G | F E | A T | Y L | 12 |
| 45 | A V | K E | Q Y | P G | 12 |
| 58 | R L | G G | T G | A F | 12 |
| 68 | E I | N G | Q L | V F | 12 |
| 71 | G Q | L V | F S | K L | 12 |
| 75 | F S | K L | E N | G G | 12 |
| 82 | G F | P Y | E K | D L | 12 |

TABLE 1-continued

C35 peptides predicted by SYFPEITHI website (score reflects ligation strength):

| | | | | | |
|---|---|---|---|---|---|
| 107 | N S | R P | P C | V I | 12 |
| 108 | S R | P P | C V | I L | 12 |

HLA-B*08 nonamers

| Pos | 1 2 | 3 4 | 5 6 | 7 8 | 9 | Score |
|---|---|---|---|---|---|---|
| 75 | F S | K L | E N | G G | F | 19 |
| 83 | F P | Y E | K D | L I | E | 19 |
| 45 | A V | K E | Q Y | P G | I | 18 |
| 85 | Y E | K D | L I | E A | I | 18 |
| 107 | N S | R P | P C | V I | L | 17 |
| 100 | E T | L E | K I | T N | S | 15 |
| 54 | E I | E S | R L | G G | T | 14 |
| 65 | F E | I E | I N | G Q | L | 14 |
| 91 | E A | I R | R A | S N | G | 14 |
| 20 | G S | G V | R I | V V | E | 12 |
| 34 | G F | E A | T Y | L E | L | 12 |
| 51 | P G | I E | I E | S R | L | 12 |
| 81 | G G | F P | Y E | K D | L | 12 |

HLA-B*1510 nonamers

| Pos | 1 2 | 3 4 | 5 6 | 7 8 | 9 | Score |
|---|---|---|---|---|---|---|
| 107 | N S | R P | P C | V I | L | 15 |
| 34 | G F | E A | T Y | L E | L | 13 |
| 51 | P G | I E | I E | S R | L | 13 |
| 81 | G G | F P | Y E | K D | L | 13 |
| 94 | R R | A S | N G | E T | L | 13 |

HLA-B*2705 nonamers

| Pos | 1 2 | 3 4 | 5 6 | 7 8 | 9 | Score |
|---|---|---|---|---|---|---|
| 57 | S R | L G | G T | G A | F | 26 |
| 94 | R R | A S | N G | E T | L | 25 |
| 67 | I E | I N | G Q | L V | F | 19 |
| 87 | K D | L I | E A | I R | R | 19 |
| 51 | P G | I E | I E | S R | L | 17 |
| 81 | G G | F P | Y E | K D | L | 17 |
| 65 | F E | I E | I N | G Q | L | 16 |
| 69 | I N | G Q | L V | F S | K | 16 |
| 96 | A S | N G | E T | L E | K | 16 |
| 16 | E V | E P | G S | G V | R | 15 |
| 34 | G F | E A | T Y | L E | L | 15 |
| 50 | Y P | G I | E I | E S | R | 15 |

TABLE 1-continued

C35 peptides predicted by SYFPEITHI website (score reflects ligation strength):

| | | | | | | |
|---|---|---|---|---|---|---|
| 70 | N G | Q L | V F | S K | L | 15 |
| 101 | T L | E K | I T | N S | R | 15 |
| 23 | V R | I V | V E | Y C | E | 14 |
| 32 | P C | G F | E A | T Y | L | 14 |
| 39 | Y L | E L | A S | A V | K | 14 |
| 79 | E N | G G | F P | Y E | K | 14 |
| 93 | I R | R A | S N | G E | T | 14 |
| 21 | S G | V R | I V | V E | Y | 13 |
| 27 | V E | Y C | E P | C G | F | 13 |
| 75 | F S | K L | E N | G G | F | 13 |
| 86 | E K | D L | I E | A I | R | 13 |
| 107 | N S | R P | P C | V I | L | 13 |
| 17 | V E | P G | S G | V R | I | 12 |
| 31 | E P | C G | F E | A T | Y | 12 |
| 77 | K L | E N | G G | F P | Y | 12 |

HLA-B*2709 nonamers

| Pos | 1 2 | 3 4 | 5 6 | 7 8 | 9 | Score |
|---|---|---|---|---|---|---|
| 94 | R R | A S | N G | E T | L | 25 |
| 57 | S R | L G | G T | G A | F | 20 |
| 81 | G G | F P | Y E | K D | L | 16 |
| 34 | G F | E A | T Y | L E | L | 14 |
| 51 | P G | I E | I E | S R | L | 13 |
| 65 | F E | I E | I N | G Q | L | 13 |
| 23 | V R | I V | V E | Y C | E | 12 |
| 107 | N S | R P | P C | V I | L | 12 |

HLA-B*5101 nonamers

| Pos | 1 2 | 3 4 | 5 6 | 7 8 | 9 | Score |
|---|---|---|---|---|---|---|
| 18 | E P | G S | G V | R I | V | 21 |
| 81 | G G | F P | Y E | K D | L | 21 |
| 51 | P G | I E | I E | S R | L | 20 |
| 70 | N G | Q L | V F | S K | L | 20 |
| 19 | P G | S G | V R | I V | V | 19 |
| 31 | E P | C G | F E | A T | Y | 19 |
| 2 | S G | E P | G Q | T S | V | 18 |
| 42 | L A | S A | V K | E Q | Y | 18 |
| 59 | L G | G T | G A | F E | I | 18 |
| 21 | S G | V R | I V | V E | Y | 14 |

TABLE 1-continued

C35 peptides predicted by SYFPEITHI website (score reflects ligation strength):

| | | | | | | |
|---|---|---|---|---|---|---|
| 83 | F P | Y E | K D | L I | E | 14 |
| 97 | S N | G E | T L | E K | I | 14 |
| 13 | P P | E E | V E | P G | S | 13 |
| 38 | T Y | L E | L A | S A | V | 13 |
| 45 | A V | K E | Q Y | P G | I | 13 |
| 63 | G A | F E | I E | I N | G | 13 |
| 94 | R R | A S | N G | E T | L | 13 |
| 12 | P P | P E | E V | E P | G | 12 |
| 33 | C G | F E | A T | Y L | E | 12 |
| 50 | Y P | G I | E I | E S | R | 12 |
| 66 | E I | E I | N G | Q L | V | 12 |
| 85 | Y E | K D | L I | E A | I | 12 |
| 95 | R A | S N | G E | T L | E | 12 |
| 105 | I T | N S | R P | P C | V | 12 |

HLA-B*5101 octamers

| Pos | 1 2 | 3 4 | 5 6 | 7 8 | Score |
|---|---|---|---|---|---|
| 83 | F P | Y E | K D | L I | 25 |
| 95 | R A | S N | G E | T L | 23 |
| 10 | V A | P P | P E | E V | 21 |
| 18 | E P | G S | G V | R I | 21 |
| 33 | C G | F E | A T | Y L | 21 |
| 98 | N G | E T | L E | K I | 19 |
| 19 | P G | S G | V R | I V | 18 |
| 60 | G G | T G | A F | E I | 18 |
| 62 | T G | A F | E I | E I | 18 |
| 63 | G A | F E | I E | I N | 14 |
| 71 | G Q | L V | F S | K L | 14 |
| 48 | E Q | Y P | G I | E I | 13 |
| 67 | I E | I N | G Q | L V | 13 |
| 106 | T N | S R | P P | C V | 12 |

Class II MHC HLA-DRB1*0101 15-mers

| Pos | 1 2 | 3 4 | 5 6 | 7 8 | 9 0 | 1 2 | 3 4 | 5 | Score |
|---|---|---|---|---|---|---|---|---|---|
| 72 | Q L | V F | S K | L E | N G | G F | P Y | E | 29 |
| 37 | A T | Y L | E L | A S | A V | K E | Q Y | P | 26 |
| 26 | V V | E Y | C E | P C | G F | E A | T Y | L | 25 |
| 63 | G A | F E | I E | I N | G Q | L V | F S | K | 25 |
| 24 | R I | V V | E Y | C E | P C | G F | E A | T | 24 |
| 36 | E A | T Y | L E | L A | S A | V K | E Q | Y | 24 |

TABLE 1-continued

C35 peptides predicted by SYFPEITHI website (score reflects ligation strength):

| | | | | | | | | | |
|---|---|---|---|---|---|---|---|---|---|
| 39 | Y L | E L | A S | A V | K E | Q Y | P G | I | 24 |
| 53 | I E | I E | S R | L G | G T | G A | F E | I | 24 |
| 56 | E S | R L | G G | T G | A F | E I | E I | N | 24 |
| 14 | P E | E V | E P | G S | G V | R I | V V | E | 23 |
| 43 | A S | A V | K E | Q Y | P G | I E | I E | S | 23 |
| 20 | G S | G V | R I | V V | E Y | C E | P C | G | 20 |
| 62 | T G | A F | E I | E I | N G | Q L | V F | S | 20 |
| 32 | P C | G F | E A | T Y | L E | L A | S A | V | 19 |
| 47 | K E | Q Y | P G | I E | I E | S R | L G | G | 19 |
| 64 | A F | E I | E I | N G | Q L | V F | S K | L | 19 |
| 82 | G F | P Y | E K | D L | I E | A I | R R | A | 19 |
| 34 | G F | E A | T Y | L E | L A | S A | V K | E | 18 |
| 54 | E I | E S | R L | G G | T G | A F | E I | E | 18 |
| 90 | I E | A I | R R | A S | N G | E T | L E | K | 18 |
| 99 | G E | T L | E K | I T | N S | R P | P C | V | 18 |
| 31 | E P | C G | F E | A T | Y L | E L | A S | A | 17 |
| 49 | Q Y | P G | I E | I E | S R | L G | G T | G | 17 |
| 58 | R L | G G | T G | A F | E I | E I | N G | Q | 17 |
| 66 | E I | E I | N G | Q L | V F | S K | L E | N | 17 |
| 67 | I E | I N | G Q | L V | F S | K L | E N | G | 17 |
| 68 | E I | N G | Q L | V F | S K | L E | N G | G | 17 |
| 84 | P Y | E K | D L | I E | A I | R R | A S | N | 17 |
| 86 | E K | D L | I E | A I | R R | A S | N G | E | 17 |
| 35 | F E | A T | Y L | E L | A S | A V | K E | Q | 16 |
| 74 | V F | S K | L E | N G | G F | P Y | E K | D | 16 |
| 87 | K D | L I | E A | I R | R A | S N | G E | T | 16 |
| 91 | E A | I R | R A | S N | G E | T L | E K | I | 16 |
| 1 | M S | G E | P G | Q T | S V | A P | P P | E | 15 |
| 4 | E P | G Q | T S | V A | P P | P E | E V | E | 15 |
| 11 | A P | P P | E E | V E | P G | S G | V R | I | 15 |
| 12 | P P | P E | E V | E P | G S | G V | R I | V | 15 |
| 29 | Y C | E P | C G | F E | A T | Y L | E L | A | 15 |
| 5 | P G | Q T | S V | A P | P P | E E | V E | P | 14 |
| 6 | G Q | T S | V A | P P | P E | E V | E P | G | 14 |
| 44 | S A | V K | E Q | Y P | G I | E I | E S | R | 14 |
| 52 | G I | E I | E S | R L | G G | T G | A F | E | 14 |

TABLE 1-continued

C35 peptides predicted by SYFPEITHI website (score reflects ligation strength):

| | | | | | | | | | |
|---|---|---|---|---|---|---|---|---|---|
| 61 | G T | G A | F E | I E | I N | G Q | L V | F | 13 |
| 50 | Y P | G I | E I | E S | R L | G G | T G | A | 12 |

HLA-DRB1*0301 (DR17) 15-mers

| Pos | 1 2 | 3 4 | 5 6 | 7 8 | 9 0 | 1 2 | 3 4 | 5 | Score |
|---|---|---|---|---|---|---|---|---|---|
| 64 | A F | E I | E I | N G | Q L | V F | S K | L | 26 |
| 39 | Y L | E L | A S | A V | K E | Q Y | P G | I | 25 |
| 72 | Q L | V F | S K | L E | N G | G F | P Y | E | 23 |
| 62 | T G | A F | E I | E I | N G | Q L | V F | S | 22 |
| 24 | R I | V V | E Y | C E | P C | G F | E A | T | 19 |
| 71 | G Q | L V | F S | K L | E N | G G | F P | Y | 19 |
| 86 | E K | D L | I E | A I | R R | A S | N G | E | 19 |
| 7 | Q T | S V | A P | P P | E E | V E | P G | S | 18 |
| 23 | V R | I V | V E | Y C | E P | C G | F E | A | 18 |
| 50 | Y P | G I | E I | E S | R L | G G | T G | A | 18 |
| 90 | I E | A I | R R | A S | N G | E T | L E | K | 18 |
| 20 | G S | G V | R I | V V | E Y | C E | P C | G | 17 |
| 87 | K D | L I | E A | I R | R A | S N | G E | T | 17 |
| 99 | G E | T L | E K | I T | N S | R P | P C | V | 16 |
| 28 | E Y | C E | P C | G F | E A | T Y | L E | L | 15 |
| 37 | A T | Y L | E L | A S | A V | K E | Q Y | P | 14 |
| 48 | E Q | Y P | G I | E I | E S | R L | G G | T | 14 |
| 78 | L E | N G | G F | P Y | E K | D L | I E | A | 14 |
| 14 | P E | E V | E P | G S | G V | R I | V V | E | 13 |
| 70 | N G | Q L | V F | S K | L E | N G | G F | P | 13 |
| 43 | A S | A V | K E | Q Y | P G | I E | I E | S | 12 |
| 52 | G I | E I | E S | R L | G G | T G | A F | E | 12 |
| 54 | E I | E S | R L | G G | T G | A F | E I | E | 12 |
| 74 | V F | S K | L E | N G | G F | P Y | E K | D | 12 |
| 82 | G F | P Y | E K | D L | I E | A I | R R | A | 12 |

HLA-DRB1*0401 (DR4Dw4) 15-mers

| Pos | 1 2 | 3 4 | 5 6 | 7 8 | 9 0 | 1 2 | 3 4 | 5 | Score |
|---|---|---|---|---|---|---|---|---|---|
| 36 | E A | T Y | L E | L A | S A | V K | E Q | Y | 28 |
| 62 | T G | A F | E I | E I | N G | Q L | V F | S | 28 |
| 86 | E K | D L | I E | A I | R R | A S | N G | E | 26 |
| 87 | K D | L I | E A | I R | R A | S N | G E | T | 26 |
| 90 | I E | A I | R R | A S | N G | E T | L E | K | 26 |
| 72 | Q L | V F | S K | L E | N G | G F | P Y | E | 22 |
| 82 | G F | P Y | E K | D L | I E | A I | R R | A | 22 |

TABLE 1-continued

C35 peptides predicted by SYFPEITHI website (score reflects ligation strength):

| | | | | | | | | | |
|---|---|---|---|---|---|---|---|---|---|
| 50 | YP | GI | EI | ES | RL | GG | TG | A | 20 |
| 99 | GE | TL | EK | IT | NS | RP | PC | V | 20 |
| 26 | VV | EY | CE | PC | GF | EA | TY | L | 16 |
| 32 | PC | GF | EA | TY | LE | LA | SA | V | 16 |
| 47 | KE | QY | PG | IE | IE | SR | LG | G | 16 |
| 80 | NG | GF | PY | EK | DL | IE | AI | R | 16 |
| 14 | PE | EV | EP | GS | GV | RI | VV | E | 14 |
| 20 | GS | GV | RI | VV | EY | CE | PC | G | 14 |
| 22 | GV | RI | VV | EY | CE | PC | GF | E | 14 |
| 37 | AT | YL | EL | AS | AV | KE | QY | P | 14 |
| 39 | YL | EL | AS | AV | KE | QY | PG | I | 14 |
| 56 | ES | RL | GG | TG | AF | EI | EI | N | 14 |
| 64 | AF | EI | EI | NG | QL | VF | SK | L | 14 |
| 66 | EI | EI | NG | QL | VF | SK | LE | N | 14 |
| 10 | VA | PP | PE | EV | EP | GS | GV | R | 12 |
| 12 | PP | PE | EV | EP | GS | GV | RI | V | 12 |
| 16 | EV | EP | GS | GV | RI | VV | EY | C | 12 |
| 29 | YC | EP | CG | FE | AT | YL | EL | A | 12 |
| 30 | CE | PC | GF | EA | TY | LE | LA | S | 12 |
| 31 | EP | CG | FE | AT | YL | EL | AS | A | 12 |
| 34 | GF | EA | TY | LE | LA | SA | VK | E | 12 |
| 35 | FE | AT | YL | EL | AS | AV | KE | Q | 12 |
| 42 | LA | SA | VK | EQ | YP | GI | EI | E | 12 |
| 48 | EQ | YP | GI | EI | ES | RL | GG | T | 12 |
| 49 | QY | PG | IE | IE | SR | LG | GT | G | 12 |
| 53 | IE | IE | SR | LG | GT | GA | FE | I | 12 |
| 58 | RL | GG | TG | AF | EI | EI | NG | Q | 12 |
| 59 | LG | GT | GA | FE | IE | IN | GQ | L | 12 |
| 61 | GT | GA | FE | IE | IN | GQ | LV | F | 12 |
| 63 | GA | FE | IE | IN | GQ | LV | FS | K | 12 |
| 67 | IE | IN | GQ | LV | FS | KL | EN | G | 12 |
| 68 | EI | NG | QL | VF | SK | LE | NG | G | 12 |
| 69 | IN | GQ | LV | FS | KL | EN | GG | F | 12 |
| 85 | YE | KD | LI | EA | IR | RA | SN | G | 12 |
| 93 | IR | RA | SN | GE | TL | EK | IT | N | 12 |
| 94 | RR | AS | NG | ET | LE | KI | TN | S | 12 |
| 96 | AS | NG | ET | LE | KI | TN | SR | P | 12 |
| 97 | SN | GE | TL | EK | IT | NS | RP | P | 12 |

TABLE 2

HLA peptide motif search results
("Start Position" = SEQ ID NO: 2 Start Position)
HLA peptide motif search results User Parameters and Scoring Information

| | |
|---|---|
| method selected to limit number of results | explicit number |
| number of results requested | 20 |
| HLA molecule type selected | A1 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 77 | KLENGGFPY | 225.000 |
| 2 | 16 | EVEPGSGVR | 90.000 |
| 3 | 29 | YCEPCGFEA | 45.000 |
| 4 | 39 | YLELASAVK | 36.000 |
| 5 | 2 | SGEPGQTSV | 2.250 |
| 6 | 26 | VVEYCEPCG | 1.800 |
| 7 | 96 | ASNGETLEK | 1.500 |
| 8 | 101 | TLEKITNSR | 0.900 |
| 9 | 89 | LIEAIRRAS | 0.900 |
| 10 | 54 | EIESRLGGT | 0.900 |
| 11 | 66 | EIEINGQLV | 0.900 |
| 12 | 52 | GIEIESRLG | 0.900 |
| 13 | 86 | EKDLIEAIR | 0.500 |
| 14 | 42 | LASAVKEQY | 0.500 |
| 15 | 31 | EPCGFEATY | 0.250 |
| 16 | 69 | INGQLVFSK | 0.250 |
| 17 | 34 | GFEATYLEL | 0.225 |
| 18 | 98 | NGETLEKIT | 0.225 |
| 19 | 61 | GTGAFEIEI | 0.125 |
| 20 | 79 | ENGGFPYEK | 0.100 |

User Parameters and Scoring Information

| | |
|---|---|
| method selected to limit number of results | explicit number |
| number of results requested | 20 |
| HLA molecule type selected | A1 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 66 | EIEInGQLVF | 45.000 |
| 2 | 16 | EVEPgSGVRI | 18.000 |
| 3 | 29 | YCEPcGFEAT | 9.000 |
| 4 | 26 | VVEYcEPCGF | 9.000 |

TABLE 2-continued

HLA peptide motif search results
("Start Position" = SEQ ID NO: 2 Start Position)
HLA peptide motif search results

| | | | |
|---|---|---|---|
| 5 | 52 | GIEIeSRLGG | 4.500 |
| 6 | 2 | SGEPgQTSVA | 2.250 |
| 7 | 89 | LIEAiRRASN | 1.800 |
| 8 | 20 | GSGVrIVVEY | 1.500 |
| 9 | 86 | EKDLiEAIRR | 1.250 |
| 10 | 98 | NGETlEKITN | 1.125 |
| 11 | 95 | RASNgETLEK | 1.000 |
| 12 | 68 | EINGqLVFSK | 1.000 |
| 13 | 54 | EIESrLGGTG | 0.900 |
| 14 | 41 | ELASaVKEQY | 0.500 |
| 15 | 100 | ETLEkITNSR | 0.250 |
| 16 | 46 | VQEKyPGIEI | 0.225 |
| 17 | 39 | YLELaSAVKE | 0.180 |
| 18 | 77 | KLENgGFPYE | 0.180 |
| 19 | 76 | SKLEnGGFPY | 0.125 |
| 20 | 48 | EQYPgIEIES | 0.075 |

User Parameters and Scoring Information

| | |
|---|---|
| method selected to limit number of results | explicit number |
| number of results requested | 20 |
| HLA molecule type selected | A_0201 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 9 | SVAPPPEEV | 2.982 |
| 2 | 104 | KITNSRPPC | 2.391 |
| 3 | 10 | ITNSRPPCV | 1.642 |
| 4 | 25 | IVVEYCEPC | 1.485 |
| 5 | 65 | FEIEINGQL | 1.018 |
| 6 | 47 | KEQYPGIEI | 0.710 |
| 7 | 88 | DLIEAIRRA | 0.703 |
| 8 | 59 | LGGTGAFEI | 0.671 |
| 9 | 61 | GTGAFEIEI | 0.551 |
| 10 | 81 | GGFPYEKDL | 0.516 |
| 11 | 37 | ATYLELASA | 0.508 |
| 12 | 35 | FEATYLELA | 0.501 |
| 13 | 15 | EEVEPGSGV | 0.416 |
| 14 | 17 | VEPGSGVRI | 0.345 |
| 15 | 97 | SNGETLEKI | 0.315 |
| 16 | 70 | NGQLVFSKL | 0.265 |
| 17 | 22 | GVRIVVEYC | 0.205 |
| 18 | 45 | AVKEQYPGI | 0.196 |
| 19 | 85 | YEKDLIEAI | 0.151 |
| 20 | 38 | TYLELASAV | 0.147 |

TABLE 2-continued

HLA peptide motif search results
("Start Position" = SEQ ID NO: 2 Start Position)
HLA peptide motif search results User Parameters and Scoring Information

| | |
|---|---|
| method selected to limit number of results | explicit number |
| number of results requested | 20 |
| HLA molecule type selected | A_0201 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 58 | RLGGtGAFEI | 60.510 |
| 2 | 104 | KITNsRPPCV | 33.472 |
| 3 | 65 | FEIEiNGQLV | 25.506 |
| 4 | 83 | FPYEkDLIEA | 4.502 |
| 5 | 33 | CGFEaTYLEL | 3.173 |
| 6 | 1 | MSGEpGQTSV | 3.165 |
| 7 | 37 | ATLYeLASAV | 3.091 |
| 8 | 50 | YPGIeIESRL | 0.641 |
| 9 | 69 | INGQlVFSKL | 0.450 |
| 10 | 17 | VEPGsGVRIV | 0.434 |
| 11 | 24 | RIVVeYCEPC | 0.335 |
| 12 | 53 | IEIEsRLGGT | 0.302 |
| 13 | 60 | GGTGaFEIEI | 0.259 |
| 14 | 8 | TSVApPPEEV | 0.222 |
| 15 | 44 | SAVKeQYPGI | 0.217 |
| 16 | 21 | SGVRiVVEYC | 0.201 |
| 17 | 55 | IESRlGGTGA | 0.164 |
| 18 | 80 | NGGFpYEKDL | 0.139 |
| 19 | 81 | GGFPyEKDLI | 0.123 |
| 20 | 105 | ITNSrPPCVI | 0.101 |

User Parameters and Scoring Information

| | |
|---|---|
| method selected to limit number of results | explicit number |
| number of results requested | 20 |
| HLA molecule type selected | A_0205 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 65 | FEIEINGQL | 8.820 |
| 2 | 25 | IVVEYCEPC | 3.060 |
| 3 | 9 | SVAPPPEEV | 2.000 |
| 4 | 104 | KITNSRPPC | 1.500 |
| 5 | 81 | GGFPYEKDL | 1.260 |
| 6 | 45 | AVKEQYPGI | 1.200 |
| 7 | 70 | NGQLVFSKL | 0.700 |
| 8 | 47 | KEQYPGIEI | 0.420 |
| 9 | 105 | ITNSRPPCV | 0.340 |

TABLE 2-continued

HLA peptide motif search results
("Start Position" = SEQ ID NO: 2 Start Position)
HLA peptide motif search results

| | | | |
|---|---|---|---|
| 10 | 37 | ATYLELASA | 0.300 |
| 11 | 35 | FEATYLELA | 0.252 |
| 12 | 17 | VEPGSGVRI | 0.238 |
| 13 | 61 | GTGAFEIEI | 0.200 |
| 14 | 97 | SNGETLEKI | 0.150 |
| 15 | 30 | CEPCGFEAT | 0.140 |
| 16 | 85 | YEKDLIEAI | 0.126 |
| 17 | 51 | PGIEIESRL | 0.105 |
| 18 | 59 | LGGTGAFEI | 0.102 |
| 19 | 22 | GVRIVVEYC | 0.100 |
| 20 | 15 | EEVEPGSGV | 0.084 |

User Parameters and Scoring Information

| | |
|---|---|
| method selected to limit number of results | explicit number |
| number of results requested | 20 |
| HLA molecule type selected | A_0205 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

| Rank | Start Position | Subsequence Residue Listing | Score (Estimate of Half Time of Disassociation of a Molecule Containing This Subsequence |
|---|---|---|---|
| 1 | 33 | CGFEaTYLEL | 6.300 |
| 2 | 104 | KITNsRPPCV | 6.000 |
| 3 | 65 | FEIEiNGQLV | 2.520 |
| 4 | 53 | IEIEsRLGGT | 1.428 |
| 5 | 83 | FPYEkDLIEA | 1.350 |
| 6 | 58 | RLGGtGAFEI | 1.200 |
| 7 | 69 | INGQlVFSKL | 1.190 |
| 8 | 50 | YPGIeIESRL | 1.050 |
| 9 | 37 | ATYLeLASAV | 0.600 |
| 10 | 1 | MSGEpGQTSV | 0.510 |
| 11 | 80 | NGGFpYEKDL | 0.420 |
| 12 | 106 | TNSRpPCVIL | 0.350 |
| 13 | 24 | RIVVeYCEPC | 0.300 |
| 14 | 44 | SAVKeQYPGI | 0.200 |
| 15 | 17 | VEPGsGVRIV | 0.190 |
| 16 | 105 | ITNSrPPCVI | 0.170 |
| 17 | 97 | SNGEtLEKIT | 0.150 |
| 18 | 55 | IESRlGGTGA | 0.119 |
| 19 | 60 | GGTGaFEIEI | 0.100 |
| 20 | 92 | AIRRaSNGET | 0.100 |

User Parameters and Scoring Information

| | |
|---|---|
| method selected to limit number of results | explicit number |
| number of results requested | 20 |
| HLA molecule type selected | A24 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

TABLE 2-continued

HLA peptide motif search results
("Start Position" = SEQ ID NO: 2 Start Position)
HLA peptide motif search results Scoring Results

| Rank | Start Position | Subsequence Residue Listing | Score (Estimate of Half Time of Disassociation of a Molecule Containing This Subsequence |
|---|---|---|---|
| 1 | 34 | GFEATYLEL | 33.000 |
| 2 | 49 | QYPGIEIES | 11.550 |
| 3 | 70 | NGQLVFSKL | 11.088 |
| 4 | 38 | TYLELASAV | 10.800 |
| 5 | 82 | GFPYEKDLI | 7.500 |
| 6 | 81 | GGFPYEKDL | 4.800 |
| 7 | 107 | NSRPPCVIL | 4.800 |
| 8 | 75 | FSKLENGGF | 2.000 |
| 9 | 97 | SNGETLEKI | 1.320 |
| 10 | 45 | AVKEQYPGI | 1.200 |
| 11 | 61 | GTGAFEIEI | 1.100 |
| 12 | 59 | LGGTGAFEI | 1.100 |
| 13 | 65 | FEIEINGQL | 1.008 |
| 14 | 51 | PGIEIESRL | 1.008 |
| 15 | 106 | TNSRPPCVI | 1.000 |
| 16 | 84 | PYEKDLIEA | 0.825 |
| 17 | 94 | RRASNGETL | 0.800 |
| 18 | 28 | EYCEPCGFE | 0.600 |
| 19 | 32 | PCGFEATYL | 0.400 |
| 20 | 47 | KEQYPGIEI | 0.330 |

User Parameters and Scoring Information

| | |
|---|---|
| method selected to limit number of results | explicit number |
| number of results requested | 20 |
| HLA molecule type selected | A24 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 64 | AFEIeINGQL | 42.000 |
| 2 | 74 | VFSKlENGGF | 10.000 |
| 3 | 84 | PYEKdLIEAI | 9.000 |
| 4 | 69 | INGQlVFSKL | 7.392 |
| 5 | 28 | EYCEpCGFEA | 6.600 |
| 6 | 50 | YPGIeIESRL | 5.600 |
| 7 | 33 | CGFEaTYLEL | 5.280 |
| 8 | 106 | TNSRpPCVIL | 4.000 |
| 9 | 31 | EPCGfEATYL | 4.000 |
| 10 | 80 | NGGFpYEKDL | 4.000 |
| 11 | 26 | VVEYcEPCGF | 3.000 |
| 12 | 66 | EIEInGQLVF | 3.000 |
| 13 | 58 | RLGGtGAFEI | 2.200 |
| 14 | 56 | ESRLgGTGAF | 2.000 |
| 15 | 16 | EVEPgSGVRI | 1.800 |
| 16 | 96 | ASNGeTLEKI | 1.650 |
| 17 | 105 | ITNSrPPCVI | 1.500 |

TABLE 2-continued

HLA peptide motif search results
("Start Position" = SEQ ID NO: 2 Start Position)
HLA peptide motif search results

| | | | |
|---|---|---|---|
| 18 | 44 | SAVKeQYPGI | 1.500 |
| 19 | 81 | GGFPyEKDLI | 1.200 |
| 20 | 60 | GGTGaFEIEI | 1.100 |

User Parameters and Scoring Information

| | |
|---|---|
| method selected to limit number of results | explicit number |
| number of results requested | 20 |
| HLA molecule type selected | A3 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 77 | KLENGGFPY | 36.000 |
| 2 | 39 | YLELASAVK | 20.000 |
| 3 | 101 | TLEKITNSR | 6.000 |
| 4 | 61 | GTGAFEIEI | 0.540 |
| 5 | 69 | INGQLVFSK | 0.360 |
| 6 | 96 | ASNGETLEK | 0.300 |
| 7 | 22 | GVRIVVEYC | 0.270 |
| 8 | 79 | ENGGFPYEK | 0.162 |
| 9 | 25 | IVVEYCEPC | 0.135 |
| 10 | 45 | AVKEQYPGI | 0.090 |
| 11 | 37 | ATYLELASA | 0.075 |
| 12 | 42 | LASAVKEQY | 0.060 |
| 13 | 104 | KITNSRPPC | 0.060 |
| 14 | 50 | YPGIEIESR | 0.060 |
| 15 | 72 | QLVFSKLEN | 0.060 |
| 16 | 16 | EVEPGSGVR | 0.054 |
| 17 | 31 | EPCGFEATY | 0.054 |
| 18 | 9 | SVAPPPEEV | 0.045 |
| 19 | 87 | KDLIEAIRR | 0.036 |
| 20 | 27 | VEYCEPCGF | 0.030 |

User Parameters and Scoring Information

| | |
|---|---|
| method selected to limit number of results | explicit number |
| number of results requested | 20 |
| HLA molecule type selected | A3 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 68 | EINGqLVFSK | 8.100 |
| 2 | 58 | RLGGtGAFEI | 2.700 |
| 3 | 41 | ELASaVQEKY | 1.800 |
| 4 | 78 | LENGgFPYEK | 0.810 |
| 5 | 95 | RASNgETLEK | 0.400 |

TABLE 2-continued

HLA peptide motif search results
("Start Position" = SEQ ID NO: 2 Start Position)
HLA peptide motif search results

| | | | |
|---|---|---|---|
| 6 | 20 | GSGVrIVVEY | 0.270 |
| 7 | 100 | ETLEkITNSR | 0.203 |
| 8 | 26 | VVEYcEPCGF | 0.200 |
| 9 | 77 | KLENgGPPYE | 0.180 |
| 10 | 66 | EIEInGQLVF | 0.120 |
| 11 | 24 | RIVVeYCEPC | 0.090 |
| 12 | 104 | KITNsRPPCV | 0.060 |
| 13 | 37 | ATYLeLASAV | 0.050 |
| 14 | 38 | TYLElASAVK | 0.045 |
| 15 | 83 | FPYEkDLIEA | 0.045 |
| 16 | 105 | ITNSrPPCVI | 0.045 |
| 17 | 72 | QLVFsKLENG | 0.045 |
| 18 | 30 | CEPCgFEATY | 0.036 |
| 19 | 22 | GVRIvVEYCE | 0.027 |
| 20 | 16 | EVEPgSGVRI | 0.027 |

User Parameters and Scoring Information

| | |
|---|---|
| method selected to limit number of results | explicit number |
| number of results requested | 20 |
| HLA molecule type selected | A_1101 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 39 | YLELASAVK | 0.400 |
| 2 | 69 | INGQLVFSK | 0.120 |
| 3 | 16 | EVEPGSGVR | 0.120 |
| 4 | 101 | TLEKITNSR | 0.080 |
| 5 | 61 | GTGAFEIEI | 0.060 |
| 6 | 50 | YPGIEIESR | 0.040 |
| 7 | 96 | ASNGETLEK | 0.040 |
| 8 | 87 | KDLIEAIRR | 0.036 |
| 9 | 77 | LENGGFPY | 0.036 |
| 10 | 79 | ENGGFPYEK | 0.024 |
| 11 | 9 | SVAPPPEEV | 0.020 |
| 12 | 45 | AVKEQYPGI | 0.020 |
| 13 | 37 | ATYLELASA | 0.020 |
| 14 | 34 | GFEATYLEL | 0.012 |
| 15 | 105 | ITNSRPPCV | 0.010 |
| 16 | 22 | GVRIVVEYC | 0.006 |
| 17 | 38 | TYLELASAV | 0.006 |
| 18 | 82 | GFPYEKDLI | 0.006 |
| 19 | 29 | YCEPCGFEA | 0.006 |
| 20 | 73 | LVFSKLENG | 0.004 |

User Parameters and Scoring Information

| | |
|---|---|
| method selected to limit number of results | explicit number |
| number of results requested | 20 |
| HLA molecule type selected | A_3101 |
| length selected for subsequences to be scored | 9 |
| echoing mode selected for input sequence | Y |
| echoing format | numbered lines |
| length of user's input peptide sequence | 115 |

TABLE 2-continued

| HLA peptide motif search results ("Start Position" = SEQ ID NO: 2 Start Position) HLA peptide motif search results | |
|---|---|
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 101 | TLEKITNSR | 2.000 |
| 2 | 16 | EVEPGSGVR | 0.600 |
| 3 | 50 | YPGIEIESR | 0.400 |
| 4 | 87 | KDLIEAIRR | 0.240 |
| 5 | 39 | YLELASAVK | 0.200 |
| 6 | 77 | KLENGGFPY | 0.180 |
| 7 | 37 | ATYLELASA | 0.060 |
| 8 | 69 | INGQLVFSK | 0.024 |
| 9 | 45 | AVKEQYPGI | 0.020 |
| 10 | 61 | GTGAFEIEI | 0.020 |
| 11 | 9 | SVAPPPEEV | 0.020 |
| 12 | 24 | RIVVEYCEP | 0.012 |
| 13 | 34 | GFEATYLEL | 0.012 |
| 14 | 73 | LVFSKLENG | 0.012 |
| 15 | 38 | TYLELASAV | 0.012 |
| 16 | 105 | ITNSRPPCV | 0.010 |
| 17 | 72 | QLVFSKLEN | 0.008 |
| 18 | 82 | GFPYEKDLI | 0.006 |
| 19 | 104 | KITNSRPPC | 0.006 |
| 20 | 79 | ENGGFPYEK | 0.006 |

User Parameters and Scoring Information

| | |
|---|---|
| method selected to limit number of results | explicit number |
| number of results requested | 20 |
| HLA molecule type selected | A_3302 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 16 | EVEPGSGVR | 45.000 |
| 2 | 101 | TLEKITNSR | 9.000 |
| 3 | 50 | YPGIEIESR | 3.000 |
| 4 | 66 | EIEINGQLV | 1.500 |
| 5 | 56 | ESRLGGTGA | 1.500 |
| 6 | 54 | EIESRLGGT | 1.500 |
| 7 | 68 | EINGQLVFS | 1.500 |
| 8 | 86 | EKDLIEAIR | 0.900 |
| 9 | 41 | ELASAVKEQ | 0.900 |
| 10 | 88 | DLIEAIRRA | 0.900 |
| 11 | 96 | ASNGETLEK | 0.500 |
| 12 | 22 | GVRIVVEYC | 0.500 |
| 13 | 1 | MSGEPGQTS | 0.500 |
| 14 | 89 | LIEAIRRAS | 0.500 |
| 15 | 107 | NSRPPCVIL | 0.500 |
| 16 | 9 | SVAPPPEEV | 0.500 |
| 17 | 38 | TYLELASAV | 0.500 |
| 18 | 25 | IVVEYCEPC | 0.500 |

TABLE 2-continued

HLA peptide motif search results ("Start Position" = SEQ ID NO: 2 Start Position) HLA peptide motif search results

| | | | |
|---|---|---|---|
| 19 | 45 | AVKEQYPGI | 0.500 |
| 20 | 49 | QYPGIEIES | 0.500 |

User Parameters and Scoring Information

| | |
|---|---|
| method selected to limit number of results | explicit number |
| number of results requested | 20 |
| HLA molecule type selected | A_3302 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 16 | EVEPGSGVR | 45.000 |
| 2 | 101 | TLEKITNSR | 9.000 |
| 3 | 50 | YPGIEIESR | 3.000 |
| 4 | 66 | EIEINGQLV | 1.500 |
| 5 | 56 | ESRLGGTGA | 1.500 |
| 6 | 54 | EIESRLGGT | 1.500 |
| 7 | 68 | EINGQLVFS | 1.500 |
| 8 | 86 | EKDLIEAIR | 0.900 |
| 9 | 41 | ELASAVKEQ | 0.900 |
| 10 | 88 | DLIEAIRRA | 0.900 |
| 11 | 96 | ASNGETLEK | 0.500 |
| 12 | 22 | GVRIVVEYC | 0.500 |
| 13 | 1 | MSGEPGQTS | 0.500 |
| 14 | 89 | LIEAIRRAS | 0.500 |
| 15 | 107 | NSRPPCVIL | 0.500 |
| 16 | 9 | SVAPPPEEV | 0.500 |
| 17 | 38 | TYLELASAV | 0.500 |
| 18 | 25 | IVVEYCEPC | 0.500 |
| 19 | 45 | AVKEQYPGI | 0.500 |
| 20 | 49 | QYPGIEIES | 0.500 |

User Parameters and Scoring Information

| | |
|---|---|
| method selected to limit number of results | explicit number |
| number of results requested | 20 |
| HLA molecule type selected | A68.1 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 16 | EVEPGSGVR | 900.000 |
| 2 | 9 | SVAPPPEEV | 12.000 |
| 3 | 50 | YPGIEIESR | 10.000 |
| 4 | 96 | ASNGETLEK | 9.000 |
| 5 | 101 | TLEKITNSR | 5.000 |
| 6 | 45 | AVKEQYPGI | 4.000 |

TABLE 2-continued

HLA peptide motif search results
("Start Position" = SEQ ID NO: 2 Start Position)
HLA peptide motif search results

| | | | |
|---|---|---|---|
| 7 | 79 | ENGGFPYEK | 3.600 |
| 8 | 39 | YLELASAVK | 3.000 |
| 9 | 61 | GTGAFEIEI | 3.000 |
| 10 | 86 | EKDLIEAIR | 2.250 |
| 11 | 69 | INGQLVFSK | 1.200 |
| 12 | 87 | KDLIEAIRR | 1.000 |
| 13 | 105 | ITNSRPPCV | 1.000 |
| 14 | 37 | ATYLELASA | 1.000 |
| 15 | 56 | ESRLGGTGA | 0.900 |
| 16 | 25 | IVVEYCEPC | 0.800 |
| 17 | 73 | LVFSKLENG | 0.800 |
| 18 | 88 | DLIEAIRRA | 0.600 |
| 19 | 18 | EPGSGVRIV | 0.600 |
| 20 | 26 | VVEYCEPCG | 0.600 |

User Parameters and Scoring Information

| | |
|---|---|
| method selected to limit number of results | explicit number |
| number of results requested | 20 |
| HLA molecule type selected | A68.1 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 16 | EVEPGSGVR | 900.000 |
| 2 | 9 | SVAPPPEEV | 12.000 |
| 3 | 50 | YPGIEIESR | 10.000 |
| 4 | 96 | ASNGETLEK | 9.000 |
| 5 | 101 | TLEKITNSR | 5.000 |
| 6 | 45 | AVKEQYPGI | 4.000 |
| 7 | 79 | ENGGFPYEK | 3.600 |
| 8 | 39 | YLELASAVK | 3.000 |
| 9 | 61 | GTGAFEIEI | 3.000 |
| 10 | 86 | EKDLIEAIR | 2.250 |
| 11 | 69 | INGQLVFSK | 1.200 |
| 12 | 87 | KDLIEAIRR | 1.000 |
| 13 | 105 | ITNSRPPCV | 1.000 |
| 14 | 37 | ATYLELASA | 1.000 |
| 15 | 56 | ESRLGGTGA | 0.900 |
| 16 | 25 | IVVEYCEPC | 0.800 |
| 17 | 73 | LVFSKLENG | 0.800 |
| 18 | 88 | DLIEAIRRA | 0.600 |
| 19 | 18 | EPGSGVRIV | 0.600 |
| 20 | 26 | VVEYCEPCG | 0.600 |

User Parameters and Scoring Information

| | |
|---|---|
| method selected to limit number of results | explicit number |
| number of results requested | 20 |
| HLA molecule type selected | A68.1 |
| length selected for subsequences to be scored | 10 |
| echoing mode selected for input sequence | Y |
| echoing format | numbered lines |
| length of user's input peptide sequence | 115 |

TABLE 2-continued

HLA peptide motif search results
("Start Position" = SEQ ID NO: 2 Start Position)
HLA peptide motif search results

| | |
|---|---|
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 100 | ETLEkITNSR | 300.000 |
| 2 | 16 | EVEPgSGVRI | 18.000 |
| 3 | 68 | EINGqLVFSK | 9.000 |
| 4 | 15 | EEVEpGSGVR | 9.000 |
| 5 | 95 | RASNgETLEK | 3.000 |
| 6 | 85 | YEKDlIEAIR | 2.250 |
| 7 | 9 | SVAPpPEEVE | 1.800 |
| 8 | 86 | EKDLiEAIRR | 1.500 |
| 9 | 73 | LVFSkLENGG | 1.200 |
| 10 | 25 | IVVEyCEPCG | 1.200 |
| 11 | 105 | ITNSrPPCVI | 1.000 |
| 12 | 37 | ATYLeLASAV | 1.000 |
| 13 | 78 | LENGgFPYEK | 0.900 |
| 14 | 8 | TSVApPPEEV | 0.600 |
| 15 | 22 | GVRIvVEYCE | 0.600 |
| 16 | 18 | EPGSgVRIVV | 0.600 |
| 17 | 1 | MSGEpGQTSV | 0.600 |
| 18 | 38 | TYLElASAVK | 0.600 |
| 19 | 49 | QYPGiEIESR | 0.500 |
| 20 | 45 | AVKEqYPGIE | 0.400 |

User Parameters and Scoring Information

| | |
|---|---|
| method selected to limit number of results | explicit number |
| number of results requested | 20 |
| HLA molecule type selected | B14 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 94 | RRASNGETL | 20.000 |
| 2 | 57 | SRLGGTGAF | 5.000 |
| 3 | 100 | ETLEKITNS | 3.375 |
| 4 | 105 | ITNSRPPCV | 2.000 |
| 5 | 88 | DLIEAIRRA | 1.350 |
| 6 | 18 | EPGSGVRIV | 1.200 |
| 7 | 70 | NGQLVFSKL | 1.000 |
| 8 | 81 | GGFPYEKDL | 1.000 |
| 9 | 54 | EIESRLGGT | 0.900 |
| 10 | 97 | SNGETLEKI | 0.600 |
| 11 | 91 | EAIRRASNG | 0.450 |
| 12 | 68 | EINGQLVFS | 0.450 |
| 13 | 65 | FEIEINGQL | 0.300 |
| 14 | 23 | VRIVVEYCE | 0.300 |
| 15 | 21 | SGVRIVVEY | 0.300 |

| HLA peptide motif search results ("Start Position" = SEQ ID NO: 2 Start Position) HLA peptide motif search results | | | |
|---|---|---|---|
| 16 | 51 | PGIEIESRL | 0.300 |
| 17 | 104 | KITNSRPPC | 0.250 |
| 18 | 48 | EQYPGIEIE | 0.225 |
| 19 | 93 | IRRANGET | 0.200 |
| 20 | 107 | NSRPPCVIL | 0.200 |

User Parameters and Scoring Information

| | |
|---|---|
| method selected to limit number of results | explicit number |
| number of results requested | 20 |
| HLA molecule type selected | B14 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 103 | EKITnSRPPC | 6.750 |
| 2 | 33 | CGFEaTYLEL | 5.000 |
| 3 | 93 | IRRAsNGETL | 4.000 |
| 4 | 18 | EPGSgVRIVV | 3.000 |
| 5 | 88 | DLIEaIRRAS | 2.250 |
| 6 | 104 | KITNsRPPCV | 2.000 |
| 7 | 106 | TNSRpPCVIL | 1.000 |
| 8 | 50 | YPGIeIESLR | 1.000 |
| 9 | 69 | INGQlVFSKL | 1.000 |
| 10 | 37 | ATYLeLASAV | 1.000 |
| 11 | 31 | EPCGfEATYL | 0.900 |
| 12 | 48 | EQYPgIEIES | 0.750 |
| 13 | 76 | SKLEnGGFPY | 0.750 |
| 14 | 83 | FPYEkDLIEA | 0.750 |
| 15 | 8 | TSVApPPEEV | 0.600 |
| 16 | 96 | ASNGeTLEKI | 0.600 |
| 17 | 44 | SAVKeQYPGI | 0.600 |
| 18 | 57 | SRLGgTAGFE | 0.500 |
| 19 | 53 | IEIEsRLGGT | 0.450 |
| 20 | 21 | SGVRiVVEYC | 0.300 |

User Parameters and Scoring Information

| | |
|---|---|
| method selected to limit number of results | explicit number |
| number of results requested | 20 |
| HLA molecule type selected | B_2705 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 94 | RRASNGETL | 6000.000 |
| 2 | 57 | SRLGGTGAF | 1000.000 |
| 3 | 93 | IRRASNGET | 200.000 |

| HLA peptide motif search results ("Start Position" = SEQ ID NO: 2 Start Position) HLA peptide motif search results | | | |
|---|---|---|---|
| 4 | 27 | VEYCEPCGF | 75.000 |
| 5 | 77 | KLENGGFPY | 45.000 |
| 6 | 39 | YLELASAVK | 30.000 |
| 7 | 65 | FEIEINGQL | 30.000 |
| 8 | 47 | KEQYPGIEI | 27.000 |
| 9 | 69 | INGQLVFSK | 20.000 |
| 10 | 23 | VRIVVEYCE | 20.000 |
| 11 | 101 | TLEKITNSR | 15.000 |
| 12 | 67 | IEINGQLVF | 15.000 |
| 13 | 107 | NSRPPCVIL | 10.000 |
| 14 | 96 | ASNGETLEK | 10.000 |
| 15 | 85 | YEKDLIEAI | 9.000 |
| 16 | 17 | VEPGSGVRI | 9.000 |
| 17 | 81 | GGFPYEKDL | 7.500 |
| 18 | 106 | TNSRPPCVI | 6.000 |
| 19 | 97 | SNGETLEKI | 6.000 |
| 20 | 75 | FSKLENGGF | 5.000 |

User Parameters and Scoring Information

| | |
|---|---|
| method selected to limit number of results | explicit number |
| number of results requested | 20 |
| HLA molecule type selected | B_2705 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 93 | IRRAaNGETL | 2000.000 |
| 2 | 94 | RRASnGETLE | 60.000 |
| 3 | 78 | LENGgFPYEK | 30.000 |
| 4 | 95 | RASNgETLEK | 30.000 |
| 5 | 58 | RLGGtGAFEI | 27.000 |
| 6 | 33 | CGFEaTYLEL | 25.000 |
| 7 | 106 | TNSRpPCVIL | 20.000 |
| 8 | 71 | GQLVfSKLEN | 20.000 |
| 9 | 23 | VRIVvEYCEP | 20.000 |
| 10 | 57 | SRLGgTGAFE | 20.000 |
| 11 | 69 | INGQlVFSKL | 20.000 |
| 12 | 30 | CEPCgFEATY | 15.000 |
| 13 | 85 | YEKDlIEAIR | 15.000 |
| 14 | 37 | ATYLeLASAV | 15.000 |
| 15 | 48 | EQYPgIEIES | 10.000 |
| 16 | 50 | YPGIeIESRL | 10.000 |
| 17 | 104 | KITNsRPPCV | 9.000 |
| 18 | 65 | FEIEiNGQLV | 9.000 |
| 19 | 81 | GGFPyEKDLI | 7.500 |
| 20 | 83 | FPYEkDLIEA | 5.000 |

User Parameters and Scoring Information

| | |
|---|---|
| method selected to limit number of results | explicit number |
| number of results requested | 20 |
| HLA molecule type selected | B_3501 |
| length selected for subsequences to be scored | 9 |
| echoing mode selected for input sequence | Y |
| echoing format | numbered lines |
| length of user's input peptide sequence | 115 |

TABLE 2-continued

HLA peptide motif search results
("Start Position" = SEQ ID NO: 2 Start Position)
HLA peptide motif search results

| | |
|---|---|
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 31 | EPCGFEATY | 40.000 |
| 2 | 75 | FSKLENGGF | 22.500 |
| 3 | 107 | NSRPPCVIL | 15.000 |
| 4 | 42 | LASAVKEQY | 6.000 |
| 5 | 18 | EPGSGVRIV | 4.000 |
| 6 | 45 | AVKEQYPGI | 2.400 |
| 7 | 21 | SGVRIVVEY | 2.000 |
| 8 | 56 | ESRLGGTGA | 1.500 |
| 9 | 77 | KLENGGFPY | 1.200 |
| 10 | 81 | GGFPYEKDL | 1.000 |
| 11 | 1 | MSGEPGQTS | 1.000 |
| 12 | 70 | NGQLVFSKL | 1.000 |
| 13 | 97 | SNGETLEKI | 0.800 |
| 14 | 83 | FPYEKDLIE | 0.400 |
| 15 | 61 | GTGAFEIEI | 0.400 |
| 16 | 59 | LGGTGAFEI | 0.400 |
| 17 | 106 | TNSRPPCVI | 0.400 |
| 18 | 50 | YPGIEIESR | 0.300 |
| 19 | 22 | GVRIVVEYC | 0.300 |
| 20 | 11 | APPPEEVEP | 0.300 |

User Parameters and Scoring Information

| | |
|---|---|
| method selected to limit number of results | explicit number |
| number of results requested | 20 |
| HLA molecule type selected | B_3501 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 31 | EPCGfEATYL | 30.000 |
| 2 | 50 | YPGIeIESRL | 20.000 |
| 3 | 56 | ESRLgGTGAF | 15.000 |
| 4 | 20 | GSGVrIVVEY | 10.000 |
| 5 | 83 | FPYEkDLIEA | 6.000 |
| 6 | 18 | EPGSgVRIVV | 4.000 |
| 7 | 33 | CGFEaTYLEL | 2.000 |
| 8 | 1 | MSGEpGQTSV | 2.000 |
| 9 | 96 | ASNGeTLEKI | 2.000 |
| 10 | 41 | ELASaVKEQY | 2.000 |
| 11 | 44 | SAVKeQYPGI | 1.200 |
| 12 | 69 | INGQlVFSKL | 1.000 |
| 13 | 8 | TSVApPPEEV | 1.000 |
| 14 | 80 | NGGFpYEKDL | 1.000 |
| 15 | 106 | TNSRpPCVIL | 1.000 |
| 16 | 58 | RLGGtGAFEI | 0.800 |
| 17 | 81 | GGFPyEKDLI | 0.600 |
| 18 | 26 | VVEYcEPCGF | 0.450 |

TABLE 2-continued

HLA peptide motif search results
("Start Position" = SEQ ID NO: 2 Start Position)
HLA peptide motif search results

| | | | |
|---|---|---|---|
| 19 | 36 | EATYlELASA | 0.450 |
| 20 | 12 | PPPEaVEPGS | 0.400 |

User Parameters and Scoring Information

| | |
|---|---|
| method selected to limit number of results | explicit number |
| number of results requested | 20 |
| HLA molecule type selected | B_3901 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 94 | RRASNGETL | 15.000 |
| 2 | 34 | GFEATYLEL | 9.000 |
| 3 | 38 | TYLELASAV | 4.000 |
| 4 | 66 | EIEINGQLV | 3.000 |
| 5 | 2 | SGEPGQTSV | 3.000 |
| 6 | 97 | SNGETLEKI | 3.000 |
| 7 | 70 | NGQLVFSKL | 3.000 |
| 8 | 81 | GGFPYEKDL | 3.000 |
| 9 | 18 | EPGSGVRIV | 1.500 |
| 10 | 65 | FEIEINGQL | 1.200 |
| 11 | 57 | SRLGGTGAF | 1.000 |
| 12 | 106 | TNSRPPCVI | 1.000 |
| 13 | 9 | SVAPPPEEV | 1.000 |
| 14 | 59 | LGGTGAFEI | 1.000 |
| 15 | 105 | ITNSRPPCV | 1.000 |
| 16 | 107 | NSRPPCVIL | 0.900 |
| 17 | 45 | AVKEQYPGI | 0.600 |
| 18 | 51 | PGIEIESRL | 0.600 |
| 19 | 88 | DLIEAIRRA | 0.600 |
| 20 | 100 | ETLEKITNS | 0.600 |

User Parameters and Scoring Information

| | |
|---|---|
| method selected to limit number of results | explicit number |
| number of results requested | 20 |
| HLA molecule type selected | B_3901 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 33 | CGFEaTYLEL | 12.000 |
| 2 | 64 | AFEIeINGQL | 9.000 |
| 3 | 93 | IRRAsNGETL | 4.500 |
| 4 | 46 | VKEQyPGIEI | 3.000 |
| 5 | 16 | EVEPgSGVRI | 3.000 |
| 6 | 106 | TNSRpPCVIL | 3.000 |

TABLE 2-continued

HLA peptide motif search results
("Start Position" = SEQ ID NO: 2 Start Position)
HLA peptide motif search results

| | | | |
|---|---|---|---|
| 7 | 69 | INGQlVFSKL | 3.000 |
| 8 | 31 | EPCGfEATYL | 3.000 |
| 9 | 44 | SAVKeQYPGI | 2.000 |
| 10 | 1 | MSGEpGQTSV | 2.000 |
| 11 | 8 | TSVApPPEEV | 2.000 |
| 12 | 37 | ATYLeLASAV | 2.000 |
| 13 | 80 | NGGFpYEKDL | 1.500 |
| 14 | 50 | YPGIeIESRL | 1.500 |
| 15 | 96 | ASNGeTLEKI | 1.500 |
| 16 | 58 | RLGGtGAFEI | 1.000 |
| 17 | 105 | ITNSrPPCVI | 1.000 |
| 18 | 81 | GGFPyEKDLI | 1.000 |
| 19 | 104 | KITNsRPPCV | 1.000 |
| 20 | 83 | FPYEkDLIEA | 0.600 |

User Parameters and Scoring Information

| | |
|---|---|
| method selected to limit number of results | explicit number |
| number of results requested | 20 |
| HLA molecule type selected | B40 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 65 | FEIEINGQL | 80.000 |
| 2 | 3 | GEPGQTSVA | 40.000 |
| 3 | 35 | FEATYLELA | 40.000 |
| 4 | 15 | EEVEPGSGV | 24.000 |
| 5 | 67 | IEINGQLVF | 16.000 |
| 6 | 81 | GGFPYEKDL | 8.000 |
| 7 | 27 | VEYCEPCGF | 8.000 |
| 8 | 47 | KEQYPGIEI | 6.000 |
| 9 | 17 | VEPGSGVRI | 4.000 |
| 10 | 30 | CEPCGFEAT | 4.000 |
| 11 | 99 | GETLEKITN | 2.400 |
| 12 | 90 | IEAIRRASN | 2.400 |
| 13 | 37 | ATYLELASA | 2.000 |
| 14 | 85 | YEKDLIEAI | 2.000 |
| 15 | 53 | IEIESRLGG | 1.600 |
| 16 | 40 | LELASAVKE | 0.800 |
| 17 | 107 | NSRPPCVIL | 0.750 |
| 18 | 29 | YCEPCGFEA | 0.500 |
| 19 | 70 | NGQLVFSKL | 0.500 |
| 20 | 78 | LENGGFPYE | 0.400 |

User Parameters and Scoring Information

| | |
|---|---|
| method selected to limit number of results | explicit number |
| number of results requested | 20 |
| HLA molecule type selected | B40 |
| length selected for subsequences to be scored | 10 |
| echoing mode selected for input sequence | Y |
| echoing format | numbered lines |
| length of user's input peptide sequence | 115 |

TABLE 2-continued

HLA peptide motif search results
("Start Position" = SEQ ID NO: 2 Start Position)
HLA peptide motif search results

| | |
|---|---|
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 55 | IESRlGGTGA | 20.000 |
| 2 | 53 | IEIEIsRLGGT | 16.000 |
| 3 | 65 | FEIEiNGQLV | 16.000 |
| 4 | 67 | IEINgQLVFS | 16.000 |
| 5 | 99 | GETLeKITNS | 8.000 |
| 6 | 35 | FEATyLELAS | 8.000 |
| 7 | 87 | KDLIeAIRRA | 5.000 |
| 8 | 17 | VEPGsGVRIV | 4.000 |
| 9 | 30 | CEPCgFEATY | 4.000 |
| 10 | 33 | CGFEaTYLEL | 2.000 |
| 11 | 15 | EEVEpGSGVR | 1.600 |
| 12 | 81 | GGFPyEKDLI | 1.600 |
| 13 | 27 | VEYCePCGFE | 1.200 |
| 14 | 83 | FPYEkDLIEA | 1.000 |
| 15 | 40 | LELAsAVKEQ | 0.800 |
| 16 | 3 | GEPGqTSVAP | 0.800 |
| 17 | 90 | IEAIrRASNG | 0.800 |
| 18 | 106 | TNSRpPCVIL | 0.750 |
| 19 | 8 | TSVApPPEEV | 0.600 |
| 20 | 2 | SGEPgQTSVA | 0.500 |

User Parameters and Scoring Information

| | |
|---|---|
| method selected to limit number of results | explicit number |
| number of results requested | 20 |
| HLA molecule type selected | B_5201 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 18 | EPGSGVRIV | 75.000 |
| 2 | 67 | IEINGQLVF | 22.500 |
| 3 | 59 | LGGTGAFEI | 11.250 |
| 4 | 98 | NGETLEKIT | 11.000 |
| 5 | 19 | PGSGVRIVV | 10.000 |
| 6 | 106 | TNSRPPCVI | 10.000 |
| 7 | 48 | EQYPGIEIE | 9.900 |
| 8 | 2 | SGEPGQTSV | 9.000 |
| 9 | 81 | GGFPYEKDL | 6.600 |
| 10 | 38 | TYLELASAV | 4.800 |
| 11 | 27 | VEYCEPCGF | 3.750 |
| 12 | 83 | FPYEKDLIE | 3.000 |
| 13 | 17 | VEPGSGVRI | 3.000 |
| 14 | 70 | NGQLVFSKL | 2.400 |
| 15 | 85 | YEKDLIEAI | 2.200 |
| 16 | 3 | GEPGQTSVA | 2.200 |
| 17 | 82 | GFPYEKDLI | 2.200 |
| 18 | 97 | SNGETLEKI | 2.178 |

TABLE 2-continued

HLA peptide motif search results
("Start Position" = SEQ ID NO: 2 Start Position)
HLA peptide motif search results

| | | | |
|---|---|---|---|
| 19 | 61 | GTGAFEIEI | 1.800 |
| 20 | 105 | ITNSRPPCV | 1.500 |

User Parameters and Scoring Information

| | |
|---|---|
| method selected to limit number of results | explicit number |
| number of results requested | 20 |
| HLA molecule type selected | B_5201 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 18 | EPGSgVRIVV | 100.000 |
| 2 | 17 | VEPGsGVRIV | 45.000 |
| 3 | 81 | GGFPyEKDLI | 33.000 |
| 4 | 105 | ITNSrPPCVI | 15.000 |
| 5 | 37 | ATYLeLASAV | 12.000 |
| 6 | 66 | EIEInGQLVF | 9.000 |
| 7 | 33 | CGFEaTYLEL | 9.000 |
| 8 | 60 | GGTGaFEIEI | 7.500 |
| 9 | 2 | SGEPgQTSVA | 6.600 |
| 10 | 83 | FPYEkDLIEA | 3.300 |
| 11 | 1 | MSGEpGQTSV | 2.700 |
| 12 | 97 | SNGEtLEKIT | 2.640 |
| 13 | 65 | FEIEiNGQLV | 2.640 |
| 14 | 50 | YPGIeIESRL | 2.400 |
| 15 | 48 | EQYPgIEIES | 2.400 |
| 16 | 106 | TNSRpPCVIL | 2.000 |
| 17 | 96 | ASNGeTLEKI | 1.815 |
| 18 | 58 | RLGGtGAFEI | 1.500 |
| 19 | 8 | TSVApPPEEV | 1.320 |
| 20 | 59 | LGGTgAFEIE | 1.238 |

User Parameters and Scoring Information

| | |
|---|---|
| method selected to limit number of results | explicit number |
| number of results requested | 20 |
| HLA molecule type selected | B60 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 65 | FEIEINGQL | 387.200 |
| 2 | 17 | VEPGSGVRI | 17.600 |
| 3 | 15 | EEVEPGSGV | 16.000 |
| 4 | 47 | KEQYPGIEI | 16.000 |
| 5 | 85 | YEKDLIEAI | 8.800 |
| 6 | 107 | NSRPPCVIL | 8.000 |

TABLE 2-continued

HLA peptide motif search results
("Start Position" = SEQ ID NO: 2 Start Position)
HLA peptide motif search results

| | | | |
|---|---|---|---|
| 7 | 35 | FEATYLELA | 8.000 |
| 8 | 70 | NGQLVFSKL | 4.840 |
| 9 | 3 | GEPGQTSVA | 4.000 |
| 10 | 81 | GGFPYEKDL | 4.000 |
| 11 | 30 | CEPCGFEAT | 4.000 |
| 12 | 67 | IEINGQLVF | 3.200 |
| 13 | 90 | IEAIRRASN | 2.400 |
| 14 | 99 | GETLEKITN | 2.400 |
| 15 | 40 | LELASAVKE | 1.760 |
| 16 | 53 | IEIESRLGG | 1.600 |
| 17 | 51 | PGIEIESRL | 0.968 |
| 18 | 55 | IESRLGGTG | 0.880 |
| 19 | 34 | GFEATYLEL | 0.800 |
| 20 | 94 | RRASNGETL | 0.800 |

User Parameters and Scoring Information

| | |
|---|---|
| method selected to limit number of results | explicit number |
| number of results requested | 20 |
| HLA molecule type selected | B60 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 65 | FEIEiNGQLV | 16.000 |
| 2 | 106 | TNSRpPCVIL | 16.000 |
| 3 | 53 | IEIEsRLGGT | 8.000 |
| 4 | 33 | CGFEaTYLEL | 8.000 |
| 5 | 17 | VEPGsGVRIV | 8.000 |
| 6 | 55 | IESRlGGTGA | 8.000 |
| 7 | 69 | INGQlVFSKL | 4.840 |
| 8 | 50 | YPGIeIESRL | 4.840 |
| 9 | 80 | NGGFpYEKDL | 4.000 |
| 10 | 31 | EPCGfEATYL | 4.000 |
| 11 | 35 | FEATyLELAS | 3.520 |
| 12 | 67 | IEINgQLVFS | 3.200 |
| 13 | 87 | KDLIeAIRRA | 1.100 |
| 14 | 78 | LENGgFPYEK | 0.800 |
| 15 | 15 | EEVEpGSGVR | 0.800 |
| 16 | 99 | GETLeKITNS | 0.800 |
| 17 | 30 | CEPCgFEATY | 0.800 |
| 18 | 90 | IEAIrRASNG | 0.800 |
| 19 | 3 | GEPGqTSVAP | 0.800 |
| 20 | 40 | LELAsAVKEQ | 0.800 |

User Parameters and Scoring Information

| | |
|---|---|
| method selected to limit number of results | explicit number |
| number of results requested | 20 |
| HLA molecule type selected | B61 |
| length selected for subsequences to be scored | 9 |
| echoing mode selected for input sequence | Y |
| echoing format | numbered lines |
| length of user's input peptide sequence | 115 |

TABLE 2-continued

HLA peptide motif search results
("Start Position" = SEQ ID NO: 2 Start Position)
HLA peptide motif search results

| | |
|---|---|
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 15 | EEVEPGSGV | 80.000 |
| 2 | 35 | FEATYLELA | 40.000 |
| 3 | 3 | GEPGQTSVA | 22.000 |
| 4 | 65 | FEIEINGQL | 16.000 |
| 5 | 85 | YEKDLIEAI | 16.000 |
| 6 | 17 | VEPGSGVRI | 8.000 |
| 7 | 47 | KEQYPGIEI | 8.000 |
| 8 | 30 | CEPCGFEAT | 4.000 |
| 9 | 99 | GETLEKITN | 2.640 |
| 10 | 90 | IEAIRRASN | 2.400 |
| 11 | 27 | VEYCEPCGF | 1.600 |
| 12 | 67 | IEINGQLVF | 1.600 |
| 13 | 2 | SGEPGQTSV | 1.000 |
| 14 | 18 | EPGSGVRIV | 1.000 |
| 15 | 105 | ITNSRPPCV | 1.000 |
| 16 | 37 | ATYLELASA | 1.000 |
| 17 | 53 | IEIESRLGG | 0.800 |
| 18 | 40 | LELASAVKE | 0.800 |
| 19 | 81 | GGFPYEKDL | 0.660 |
| 20 | 29 | YCEPCGFEA | 0.500 |

User Parameters and Scoring Information

| | |
|---|---|
| method selected to limit number of results | explicit number |
| number of results requested | 20 |
| HLA molecule type selected | B61 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 65 | FEIEiNGQLV | 80.000 |
| 2 | 17 | VEPGsGVRIV | 40.000 |
| 3 | 55 | IESRlGGTGA | 20.000 |
| 4 | 87 | KDLIeAIRRA | 10.000 |
| 5 | 53 | IEIEsRLGGT | 8.000 |
| 6 | 14 | PEEVePGSGV | 4.000 |
| 7 | 99 | GETLeKITNS | 3.520 |
| 8 | 37 | ATYLeLASAV | 2.000 |
| 9 | 8 | TSVApPPEEV | 2.000 |
| 10 | 67 | IEINgQLVFS | 1.600 |
| 11 | 35 | FEATyLELAS | 1.600 |
| 12 | 1 | MSGEpGQTSV | 1.000 |
| 13 | 18 | EPGSgVRIVV | 1.000 |
| 14 | 36 | EATYlELASA | 1.000 |
| 15 | 83 | FPYEkDLIEA | 1.000 |
| 16 | 15 | EEVEpGSGVR | 0.800 |
| 17 | 27 | VEYCePCGFE | 0.800 |
| 18 | 30 | CEPCgFEATY | 0.800 |
| 19 | 90 | IEAIrRASNG | 0.800 |
| 20 | 40 | LELAaAVKEQ | 0.800 |

User Parameters and Scoring Information

| | |
|---|---|
| method selected to limit number of results | explicit number |
| number of results requested | 20 |
| HLA molecule type selected | B62 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 77 | KLENGGFPY | 24.000 |
| 2 | 21 | SGVRIVVEY | 4.800 |
| 3 | 75 | FSKLENGGF | 3.000 |
| 4 | 31 | EPCGFEATY | 2.640 |
| 5 | 88 | DLIEAIRRA | 2.200 |
| 6 | 42 | LASAVKEQY | 2.000 |
| 7 | 48 | EQYPGIEIE | 0.960 |
| 8 | 71 | GQLVFSKLE | 0.800 |
| 9 | 6 | GQTSVAPPP | 0.800 |
| 10 | 67 | IEINGQLVF | 0.686 |
| 11 | 22 | GVRIVVEYC | 0.660 |
| 12 | 58 | RLGGTGAFE | 0.480 |
| 13 | 57 | SRLGGTGAF | 0.480 |
| 14 | 18 | EPGSGVRIV | 0.400 |
| 15 | 59 | LGGTGAFEI | 0.400 |
| 16 | 56 | ESRLGGTGA | 0.360 |
| 17 | 45 | AVKEQYPGI | 0.330 |
| 18 | 104 | KITNSRPPC | 0.250 |
| 19 | 72 | QLVFSKLEN | 0.240 |
| 20 | 61 | GTGAFEIEI | 0.240 |

User Parameters and Scoring Information

| | |
|---|---|
| method selected to limit number of results | explicit number |
| number of results requested | 20 |
| HLA molecule type selected | B62 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 41 | ELASaVKEQY | 40.000 |
| 2 | 58 | RLGGtGAFEI | 9.600 |
| 3 | 66 | EIEInGQLVF | 7.920 |
| 4 | 56 | ESRLgGTGAF | 6.000 |
| 5 | 20 | GSGVrIVVEY | 4.800 |
| 6 | 92 | AIRRaSNGET | 1.500 |

TABLE 2-continued

HLA peptide motif search results
("Start Position" = SEQ ID NO: 2 Start Position)
HLA peptide motif search results

| | | | |
|---|---|---|---|
| 7 | 48 | EQYPgIEIES | 1.152 |
| 8 | 26 | VVEYcEPCGF | 0.600 |
| 9 | 24 | RIVVeYCEPC | 0.500 |
| 10 | 104 | KITNsRPPCV | 0.500 |
| 11 | 71 | GQLVfSKLEN | 0.480 |
| 12 | 76 | SKLEnGGFPY | 0.440 |
| 13 | 88 | DLIEaIRRAS | 0.440 |
| 14 | 6 | GQTSvSPPPE | 0.400 |
| 15 | 1 | MSGEpGQTSV | 0.264 |
| 16 | 18 | EPGSgVRIVV | 0.264 |
| 17 | 69 | INGQlVFSKL | 0.260 |
| 18 | 21 | SGVRiVVEYC | 0.220 |
| 19 | 30 | CEPCgFEATY | 0.220 |
| 20 | 74 | VFSKlENGGF | 0.200 |

User Parameters and Scoring Information

| | |
|---|---|
| method selected to limit number of results | explicit number |
| number of results requested | 20 |
| HLA molecule type selected | B7 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 107 | NSRPPCVIL | 60.000 |
| 2 | 45 | AVKEQYPGI | 6.000 |
| 3 | 22 | GVRIVVEYC | 5.000 |
| 4 | 70 | NGQLVFSKL | 4.000 |
| 5 | 81 | GGFPYEKDL | 4.000 |
| 6 | 18 | EPGSGVRIV | 4.000 |
| 7 | 9 | SVAPPPEEV | 1.500 |
| 8 | 56 | ESRLGGTGA | 1.000 |
| 9 | 106 | TNSRPPCVI | 0.600 |
| 10 | 11 | APPPEEVEP | 0.600 |
| 11 | 25 | IVVEYCEPC | 0.500 |
| 12 | 65 | FEIEINGQL | 0.400 |
| 13 | 61 | GTGAFEIEI | 0.400 |
| 14 | 31 | EPCGFEATY | 0.400 |
| 15 | 94 | RRASNGETL | 0.400 |
| 16 | 59 | LGGTGAFEI | 0.400 |
| 17 | 51 | PGIEIESRL | 0.400 |
| 18 | 32 | PCGFEATYL | 0.400 |
| 19 | 97 | SNGETLEKI | 0.400 |
| 20 | 92 | AIRRASNGE | 0.300 |

User Parameters and Scoring Information

| | |
|---|---|
| method selected to limit number of results | explicit number |
| number of results requested | 20 |
| HLA molecule type selected | B7 |
| length selected for subsequences to be scored | 10 |
| echoing mode selected for input sequence | Y |
| echoing format | numbered lines |
| length of user's input peptide sequence | 115 |

TABLE 2-continued

HLA peptide motif search results
("Start Position" = SEQ ID NO: 2 Start Position)
HLA peptide motif search results

| | |
|---|---|
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 50 | YPGIeIESRL | 80.000 |
| 2 | 31 | EPCGfEATYL | 80.000 |
| 3 | 18 | EPGSgVRIVV | 6.000 |
| 4 | 106 | TNSRpPCVIL | 6.000 |
| 5 | 80 | NGGFpYEKDL | 4.000 |
| 6 | 69 | INGQlVFSKL | 4.000 |
| 7 | 93 | IRRAsNGETL | 4.000 |
| 8 | 33 | CGFEaTYLEL | 4.000 |
| 9 | 92 | AIRRaSNGET | 3.000 |
| 10 | 83 | FPYEkDLIEA | 2.000 |
| 11 | 44 | SAVKeQYPGI | 1.200 |
| 12 | 96 | ASNGeTLEKI | 1.200 |
| 13 | 11 | APPPeEVEPG | 0.600 |
| 14 | 16 | EVEPgSGVRI | 0.600 |
| 15 | 37 | ATYLeLASAV | 0.600 |
| 16 | 105 | ITNSrPPCVI | 0.600 |
| 17 | 22 | GVRIvVEYCE | 0.500 |
| 18 | 60 | GGTGaFEIEI | 0.400 |
| 19 | 81 | GGFPyEKDLI | 0.400 |
| 20 | 58 | RLGGtGAFEI | 0.400 |

User Parameters and Scoring Information

| | |
|---|---|
| method selected to limit number of results | explicit number |
| number of results requested | 20 |
| HLA molecule type selected | B8 |
| length selected for subsequences to be scored | 8 |
| echoing mode selected for input sequence | Y |
| echoing format | numbered lines |
| length of user's input peptide sequence | 115 |
| number of subsequence scores calculated | 108 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 83 | FPYEKDLI | 6.000 |
| 2 | 107 | NSRPPCVI | 1.000 |
| 3 | 91 | EAIRRASN | 0.800 |
| 4 | 20 | GSGVRIVV | 0.600 |
| 5 | 18 | EPGSGVRI | 0.400 |
| 6 | 95 | RASNGETL | 0.400 |
| 7 | 100 | ETLEKITN | 0.300 |
| 8 | 105 | ITNSRPPC | 0.200 |
| 9 | 10 | VAPPPEEV | 0.120 |
| 10 | 73 | LVFSKLEN | 0.100 |
| 11 | 43 | ASAVKEQY | 0.100 |
| 12 | 22 | GVRIVVEY | 0.100 |
| 13 | 36 | EATYLELA | 0.080 |
| 14 | 31 | EPCGFEAT | 0.080 |
| 15 | 66 | EIEINGQL | 0.080 |
| 16 | 4 | EPGQTSVA | 0.080 |
| 17 | 33 | CGFEATYL | 0.060 |
| 18 | 71 | GQLVFSKL | 0.060 |

TABLE 2-continued

HLA peptide motif search results
("Start Position" = SEQ ID NO: 2 Start Position)
HLA peptide motif search results

| | | | |
|---|---|---|---|
| 19 | 56 | ESRLGGTG | 0.040 |
| 20 | 106 | TNSRPPCV | 0.030 |

User Parameters and Scoring Information

| | |
|---|---|
| method selected to limit number of results | explicit number |
| number of results requested | 20 |
| HLA molecule type selected | B8 |
| length selected for subsequences to be scored | 8 |
| echoing mode selected for input sequence | Y |
| echoing format | numbered lines |
| length of user's input peptide sequence | 115 |
| number of subsequence scores calculated | 108 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 83 | FPYEKDLI | 6.000 |
| 2 | 107 | NSRPPCVI | 1.000 |
| 3 | 91 | EAIRRASN | 0.800 |
| 4 | 20 | GSGVRIVV | 0.600 |
| 5 | 18 | EPGSGVRI | 0.400 |
| 6 | 95 | RASNGETL | 0.400 |
| 7 | 100 | ETLEKITN | 0.300 |
| 8 | 105 | ITNSRPPC | 0.200 |
| 9 | 10 | VAPPPEEV | 0.120 |
| 10 | 73 | LVFSKLEN | 0.100 |
| 11 | 43 | ASAVKEQY | 0.100 |
| 12 | 22 | GVRIVVEY | 0.100 |
| 13 | 36 | EATYLELA | 0.080 |
| 14 | 31 | EPCGFEAT | 0.080 |
| 15 | 66 | EIEINGQL | 0.080 |
| 16 | 4 | EPGQTSVA | 0.080 |
| 17 | 33 | CGFEATYL | 0.060 |
| 18 | 71 | GQLVFSKL | 0.060 |
| 19 | 56 | ESRLGGTG | 0.040 |
| 20 | 106 | TNSRPPCV | 0.030 |

User Parameters and Scoring Information

| | |
|---|---|
| method selected to limit number of results | explicit number |
| number of results requested | 20 |
| HLA molecule type selected | Cw_0702 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 20 | GSGVrIVVEY | 38.400 |
| 2 | 30 | CEPCgFEATY | 16.000 |
| 3 | 41 | ELASaVKEQY | 16.000 |
| 4 | 50 | YPGIeIESRL | 7.920 |
| 5 | 76 | SKLEnGGFPY | 4.000 |
| 6 | 69 | INGQlVFSKL | 2.880 |
| 7 | 18 | EPGSgVRIVV | 2.400 |
| 8 | 33 | CGFEaTYLEL | 1.440 |
| 9 | 80 | HGGFpYEKDL | 1.440 |
| 10 | 56 | ESRLgGTGAF | 1.200 |
| 11 | 93 | IRRAsNGETL | 1.200 |
| 12 | 64 | AFEIeINGQL | 1.200 |
| 13 | 66 | EIEInGQLVF | 1.000 |
| 14 | 35 | FEATyLELAS | 0.960 |
| 15 | 87 | KDLIeAIRRA | 0.800 |
| 16 | 97 | SNGEtLEKIT | 0.800 |
| 17 | 17 | VEPGsGVRIV | 0.800 |
| 18 | 21 | SGVRiVVEYC | 0.800 |
| 19 | 28 | EYCEpCGFEA | 0.720 |
| 20 | 48 | EQYPgIEIES | 0.672 |

User Parameters and Scoring Information

| | |
|---|---|
| method selected to limit number of results | explicit number |
| number of results requested | 20 |
| HLA molecule type selected | B8 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 50 | YPGIeIESRL | 0.800 |
| 2 | 93 | IRRAsNGETL | 0.400 |
| 3 | 31 | EPCGfEATYL | 0.320 |
| 4 | 104 | KITNsRPPCV | 0.300 |
| 5 | 18 | EPGSgVRIVV | 0.240 |
| 6 | 56 | ESRLgGTGAF | 0.200 |
| 7 | 44 | SAVKeQYPGI | 0.200 |
| 8 | 92 | AIRRaSNGET | 0.200 |
| 9 | 69 | INGQlVFSKL | 0.200 |
| 10 | 106 | TNSRpPCVIL | 0.200 |
| 11 | 42 | LASAvKEQYP | 0.160 |
| 12 | 33 | CGFEaTYLEL | 0.060 |
| 13 | 105 | ITNSrPPCVI | 0.050 |
| 14 | 58 | RLGGtGAFEI | 0.050 |
| 15 | 96 | ASNGeTLEKI | 0.050 |
| 16 | 1 | MSGEpGQTSV | 0.045 |
| 17 | 75 | FSKLeNGGFP | 0.040 |
| 18 | 80 | NGGFpYEKDL | 0.040 |
| 19 | 72 | QLVFsKLENG | 0.040 |
| 20 | 53 | IEIEsRLGGT | 0.030 |

User Parameters and Scoring Information

| | |
|---|---|
| method selected to limit number of results | explicit number |
| number of results requested | 20 |
| HLA molecule type selected | B_2702 |
| length selected for subsequences to be scored | 9 |
| echoing mode selected for input sequence | Y |
| echoing format | numbered lines |
| length of user's input peptide sequence | 115 |

TABLE 2-continued

HLA peptide motif search results
("Start Position" = SEQ ID NO: 2 Start Position)
HLA peptide motif search results

| | |
|---|---|
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 57 | SRLGGTGAF | 200.000 |
| 2 | 94 | RRASNGETL | 180.000 |
| 3 | 93 | IRRASNGET | 20.000 |
| 4 | 27 | VEYCEPCGF | 15.000 |
| 5 | 77 | KLENGGFPY | 9.000 |
| 6 | 67 | IEINGQLVF | 3.000 |
| 7 | 47 | KEQYPGIEI | 2.700 |
| 8 | 23 | VRIVVEYCE | 2.000 |
| 9 | 42 | LASAVKEQY | 1.000 |
| 10 | 75 | FSKLENGGF | 1.000 |
| 11 | 85 | YEKDLIEAI | 0.900 |
| 12 | 17 | VEPGSGVRI | 0.900 |
| 13 | 65 | FEIEINGQL | 0.900 |
| 14 | 97 | SNGETLEKI | 0.600 |
| 15 | 106 | TNSRPPCVI | 0.600 |
| 16 | 37 | ATYLELASA | 0.500 |
| 17 | 21 | SGVRIVVEY | 0.500 |
| 18 | 107 | NSRPPCVIL | 0.300 |
| 19 | 30 | CEPCGFEAT | 0.300 |
| 20 | 48 | EQYPGIEIE | 0.300 |

User Parameters and Scoring Information

| | |
|---|---|
| method selected to limit number of results | explicit number |
| number of results requested | 20 |
| HLA molecule type selected | B_2702 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 93 | IRRAsNGETL | 60.000 |
| 2 | 94 | RRASnGETLE | 6.000 |
| 3 | 30 | CEPCgFEATY | 3.000 |
| 4 | 58 | RLGGtGAFEI | 2.700 |
| 5 | 23 | VRIVvEYCEP | 2.000 |
| 6 | 57 | SRLGgTGAFE | 2.000 |
| 7 | 48 | EQYPgIEIES | 1.500 |
| 8 | 26 | VVEYcEPCGF | 1.000 |
| 9 | 20 | GSGVrIVVEY | 1.000 |
| 10 | 71 | GQLVfSKLEN | 1.000 |
| 11 | 41 | ELASaVKEQY | 0.900 |
| 12 | 33 | CGFEaTYLEL | 0.750 |
| 13 | 81 | GGFPyEKDLI | 0.750 |
| 14 | 106 | TNSRpPCVIL | 0.600 |
| 15 | 69 | INGQlVFSKL | 0.600 |
| 16 | 83 | FPYEkDLIEA | 0.500 |
| 17 | 37 | ATYLeLASAV | 0.500 |
| 18 | 55 | IESRlGGTGA | 0.300 |
| 19 | 96 | ASNGeTLEKI | 0.300 |
| 20 | 56 | ESRLgGTGAF | 0.300 |

User Parameters and Scoring Information

| | |
|---|---|
| method selected to limit number of results | explicit number |
| number of results requested | 20 |
| HLA molecule type selected | B_3701 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 65 | FEIEiNGQLV | 10.000 |
| 2 | 67 | IEINgQLVFS | 5.000 |
| 3 | 81 | GGFPyEKDLI | 5.000 |
| 4 | 87 | KDLIeAIRRA | 4.000 |
| 5 | 30 | CEPCgFEATY | 2.000 |
| 6 | 17 | VEPGsGVRIV | 2.000 |
| 7 | 50 | YPGIeIESRL | 1.500 |
| 8 | 64 | AFEIeINGQL | 1.500 |
| 9 | 69 | INGQlVFSKL | 1.500 |
| 10 | 99 | GETLeKITNS | 1.000 |
| 11 | 60 | GGTGaFEIEI | 1.000 |
| 12 | 46 | VKEQyPGIEI | 1.000 |
| 13 | 53 | IEIEsRLGGT | 1.000 |
| 14 | 16 | EVEPgSGVRI | 1.000 |
| 15 | 44 | SAVKeQYPGI | 1.000 |
| 16 | 105 | ITNSrPPCVI | 1.000 |
| 17 | 96 | ASNGeTLEKI | 1.000 |
| 18 | 80 | NGGFpYEKDL | 1.000 |
| 19 | 55 | IESRlGGTGA | 1.000 |
| 20 | 31 | EPCGfEATYL | 1.000 |

User Parameters and Scoring Information

| | |
|---|---|
| method selected to limit number of results | explicit number |
| number of results requested | 20 |
| HLA molecule type selected | B_3801 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 34 | GFEATYLEL | 6.000 |
| 2 | 70 | NGQLVFSKL | 1.560 |
| 3 | 38 | TYLELASAV | 1.040 |
| 4 | 81 | GGFPYEKDL | 1.000 |
| 5 | 97 | SNGETLEKI | 0.720 |
| 6 | 66 | EIEINGQLV | 0.600 |

TABLE 2-continued

| HLA peptide motif search results ("Start Position" = SEQ ID NO: 2 Start Position) HLA peptide motif search results | | | |
|---|---|---|---|
| 7 | 2 | SGEPGQTSV | 0.600 |
| 8 | 82 | GFPYEKDLI | 0.600 |
| 9 | 49 | QYPGIEIES | 0.520 |
| 10 | 18 | EPGSGVRIV | 0.400 |
| 11 | 31 | EPCGFEATY | 0.400 |
| 12 | 89 | LIEAIRRAS | 0.390 |
| 13 | 98 | NGETLEKIT | 0.390 |
| 14 | 77 | KLENGGFPY | 0.300 |
| 15 | 61 | GTGAFEIEI | 0.300 |
| 16 | 107 | NSRPPCVIL | 0.300 |
| 17 | 75 | FSKLENGGF | 0.300 |
| 18 | 106 | TNSRPPCVI | 0.300 |
| 19 | 29 | YCEPCGFEA | 0.300 |
| 20 | 54 | EIESRLGGT | 0.300 |

User Parameters and Scoring Information

| | |
|---|---|
| method selected to limit number of results | explicit number |
| number of results requested | 20 |
| HLA molecule type selected | B_3801 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 64 | AFEIeINGQL | 7.800 |
| 2 | 31 | EPCGfEATYL | 4.800 |
| 3 | 66 | EIEInGQLVF | 3.000 |
| 4 | 26 | VVEYcEPCGF | 3.000 |
| 5 | 50 | YPGIeIESRL | 2.600 |
| 6 | 74 | VFSKlENGGF | 2.000 |
| 7 | 33 | CGFEaTYLEL | 2.000 |
| 8 | 69 | INGQlVFSKL | 1.560 |
| 9 | 106 | TNSRpPCVIL | 1.000 |
| 10 | 80 | NGGFpYEKDL | 1.000 |
| 11 | 16 | EVEPgSGVRI | 0.900 |
| 12 | 96 | ASNGeTLEKI | 0.720 |
| 13 | 34 | GFEAtYLELA | 0.600 |
| 14 | 60 | GGTGaFEIEI | 0.600 |
| 15 | 58 | RLGGtGAFEI | 0.600 |
| 16 | 18 | EPGSgVRIVV | 0.520 |
| 17 | 83 | FPYEkDLIEA | 0.400 |
| 18 | 28 | EYCEpCGFEA | 0.400 |
| 19 | 1 | MSGEpGQTSV | 0.400 |
| 20 | 2 | SGEPgQTSVA | 0.300 |

User Parameters and Scoring Information

| | |
|---|---|
| method selected to limit number of results | explicit number |
| number of results requested | 20 |
| HLA molecule type selected | B_3902 |
| length selected for subsequences to be scored | 9 |
| echoing mode selected for input sequence | Y |
| echoing format | numbered lines |
| length of user's input peptide sequence | 115 |

TABLE 2-continued

HLA peptide motif search results ("Start Position" = SEQ ID NO: 2 Start Position) HLA peptide motif search results

| | |
|---|---|
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 70 | NGQLVFSKL | 2.400 |
| 2 | 81 | GGFPYEKDL | 2.400 |
| 3 | 94 | RRASNGETL | 2.000 |
| 4 | 34 | GFEATYLEL | 2.000 |
| 5 | 107 | NSRPPCVIL | 0.600 |
| 6 | 57 | SRLGGTGAF | 0.500 |
| 7 | 65 | FEIEINGQL | 0.480 |
| 8 | 51 | PGIEIESRL | 0.240 |
| 9 | 32 | PCGFEATYL | 0.200 |
| 10 | 75 | FSKLENGGF | 0.150 |
| 11 | 86 | EKDLIEAIR | 0.120 |
| 12 | 6 | GQTSVAPPP | 0.120 |
| 13 | 71 | GQLVFSKLE | 0.120 |
| 14 | 46 | VKEQYPGIE | 0.120 |
| 15 | 89 | LIEAIRRAS | 0.120 |
| 16 | 21 | SGVRIVVEY | 0.120 |
| 17 | 98 | NGETLEKIT | 0.120 |
| 18 | 36 | EATYLELAS | 0.120 |
| 19 | 38 | TYLELASAV | 0.120 |
| 20 | 31 | EPCGFEATY | 0.120 |

User Parameters and Scoring Information

| | |
|---|---|
| method selected to limit number of results | explicit number |
| number of results requested | 20 |
| HLA molecule type selected | B_3902 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 70 | NGQLVFSKL | 2.400 |
| 2 | 81 | GGFPYEKDL | 2.400 |
| 3 | 94 | RRASNGETL | 2.000 |
| 4 | 34 | GFEATYLEL | 2.000 |
| 5 | 107 | NSRPPCVIL | 0.600 |
| 6 | 57 | SRLGGTGAF | 0.500 |
| 7 | 65 | FEIEINGQL | 0.480 |
| 8 | 51 | PGIEIESRL | 0.240 |
| 9 | 32 | PCGFEATYL | 0.200 |
| 10 | 75 | FSKLENGGF | 0.150 |
| 11 | 86 | EKDLIEAIR | 0.120 |
| 12 | 6 | GQTSVAPPP | 0.120 |
| 13 | 71 | GQLVFSKLE | 0.120 |
| 14 | 46 | VKEQYPGIE | 0.120 |
| 15 | 89 | LIEAIRRAS | 0.120 |
| 16 | 21 | SGVRIVVEY | 0.120 |
| 17 | 98 | NGETLEKIT | 0.120 |
| 18 | 36 | EATYLELAS | 0.120 |

TABLE 2-continued

HLA peptide motif search results
("Start Position" = SEQ ID NO: 2 Start Position)
HLA peptide motif search results

| | | | |
|---|---|---|---|
| 19 | 38 | TYLELASAV | 0.120 |
| 20 | 31 | EPCGFEATY | 0.120 |

User Parameters and Scoring Information

| | |
|---|---|
| method selected to limit number of results | explicit number |
| number of results requested | 20 |
| HLA molecule type selected | B_3902 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 69 | INGQlVFSKL | 2.400 |
| 2 | 64 | AFEIeINGQL | 2.400 |
| 3 | 50 | YPGIeIESRL | 2.400 |
| 4 | 80 | NGGFpYEKDL | 2.400 |
| 5 | 106 | TNSRpPCVIL | 2.000 |
| 6 | 31 | EPCGfEATYL | 2.000 |
| 7 | 33 | CGFEaTYLEL | 2.000 |
| 8 | 48 | EQYPgIEIES | 1.200 |
| 9 | 76 | SKLEnGGFPY | 1.000 |
| 10 | 71 | GQLVfSKLEN | 1.000 |
| 11 | 46 | VKEQyPGIEI | 1.000 |
| 12 | 103 | EKITnSRPPC | 1.000 |
| 13 | 93 | IRRAsNGETL | 0.600 |
| 14 | 66 | EIEInGQLVF | 0.500 |
| 15 | 26 | VVEYcEPCGF | 0.500 |
| 16 | 74 | VFSKlENGGF | 0.500 |
| 17 | 56 | ESRLgTGAF | 0.150 |
| 18 | 24 | RIVVeYCEPC | 0.120 |
| 19 | 34 | GFEAtYLELA | 0.120 |
| 20 | 60 | GGTGaFEIEI | 0.120 |

User Parameters and Scoring Information

| | |
|---|---|
| method selected to limit number of results | explicit number |
| number of results requested | 20 |
| HLA molecule type selected | B_4403 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 67 | IEINGQLVF | 200.000 |
| 2 | 27 | VEYCEPCGF | 40.000 |
| 3 | 21 | SGVRIVVEY | 36.000 |
| 4 | 65 | FEIEINGQL | 20.000 |
| 5 | 35 | FEATYLELA | 12.000 |
| 6 | 3 | GEPGQTSVA | 9.000 |

TABLE 2-continued

HLA peptide motif search results
("Start Position" = SEQ ID NO: 2 Start Position)
HLA peptide motif search results

| | | | |
|---|---|---|---|
| 7 | 15 | EEVEPGSGV | 8.000 |
| 8 | 17 | VEPGSGVRI | 6.000 |
| 9 | 42 | LASAVKEQY | 4.500 |
| 10 | 31 | EPCGFEATY | 4.500 |
| 11 | 85 | YEKDLIEAI | 4.000 |
| 12 | 30 | CEPCGFEAT | 4.000 |
| 13 | 47 | KEQYPGIEI | 4.000 |
| 14 | 90 | IEAIRRASN | 3.600 |
| 15 | 53 | IEIESRLGG | 2.000 |
| 16 | 40 | LELASAVKE | 1.800 |
| 17 | 99 | GETLEKITN | 1.200 |
| 18 | 75 | FSKLENGGF | 1.000 |
| 19 | 57 | SRLGGTGAF | 0.900 |
| 20 | 78 | LENGGFPYE | 0.600 |

User Parameters and Scoring Information

| | |
|---|---|
| method selected to limit number of results | explicit number |
| number of results requested | 20 |
| HLA molecule type selected | B_4403 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 30 | CEPCgFEATY | 120.000 |
| 2 | 53 | IEIEsRLGGT | 30.000 |
| 3 | 67 | IEINgQLVFS | 30.000 |
| 4 | 65 | FEIEiNGQLV | 20.000 |
| 5 | 17 | VEPGsGVRIV | 18.000 |
| 6 | 20 | GSGVrIVVEY | 9.000 |
| 7 | 99 | GETLeKITNS | 9.000 |
| 8 | 35 | FEATyLELAS | 8.000 |
| 9 | 55 | IESRlGGTGA | 6.000 |
| 10 | 40 | LELAsAVKEQ | 5.400 |
| 11 | 87 | KDLIeAIRRA | 2.250 |
| 12 | 76 | SKLEnGGFPY | 1.800 |
| 13 | 90 | IEAIrRASNG | 1.800 |
| 14 | 21 | SGVRiVVEYC | 1.800 |
| 15 | 56 | ESRLgGTGAF | 1.500 |
| 16 | 41 | ELASaVKEQY | 0.900 |
| 17 | 15 | EEVEpGSGVR | 0.800 |
| 18 | 96 | ASNGeTLEKI | 0.675 |
| 19 | 3 | GEPGqTSVAP | 0.600 |
| 20 | 78 | LENGgFPYEK | 0.600 |

User Parameters and Scoring Information

| | |
|---|---|
| method selected to limit number of results | explicit number |
| number of results requested | 20 |
| HLA molecule type selected | B_5101 |
| length selected for subsequences to be scored | 9 |
| echoing mode selected for input sequence | Y |
| echoing format | numbered lines |
| length of user's input peptide sequence | 115 |

TABLE 2-continued

| HLA peptide motif search results ("Start Position" = SEQ ID NO: 2 Start Position) HLA peptide motif search results | |
|---|---|
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 18 | EPGSGVRIV | 484.000 |
| 2 | 59 | LGGTGAFEI | 114.400 |
| 3 | 2 | SGEPGQTSV | 48.400 |
| 4 | 81 | GGFPYEKDL | 44.000 |
| 5 | 70 | NGQLVFSKL | 22.000 |
| 6 | 31 | EPCGFEATY | 7.260 |
| 7 | 97 | SNGETLEKI | 5.856 |
| 8 | 36 | EATYLELAS | 5.000 |
| 9 | 19 | PGSGVRIVV | 4.840 |
| 10 | 66 | EIEINGQLV | 4.840 |
| 11 | 45 | AVKEQYPGI | 4.400 |
| 12 | 82 | GFPYEKDLI | 4.400 |
| 13 | 61 | GTGAFEIEI | 4.000 |
| 14 | 106 | TNSRPPCVI | 4.000 |
| 15 | 83 | FPYEKDLIE | 2.860 |
| 16 | 105 | ITNSRPPCV | 2.600 |
| 17 | 42 | LASAVKEQY | 2.595 |
| 18 | 51 | PGIEIESRL | 2.420 |
| 19 | 4 | EPGQTSVAP | 2.200 |
| 20 | 9 | SVAPPPEEV | 2.200 |

User Parameters and Scoring Information

| | |
|---|---|
| method selected to limit number of results | explicit number |
| number of results requested | 20 |
| HLA molecule type selected | B_5101 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 18 | EPGSgVRIVV | 440.000 |
| 2 | 44 | SAVKeQYPGI | 220.000 |
| 3 | 31 | EPCGfEATYL | 220.000 |
| 4 | 81 | GGFPyEKDLI | 176.000 |
| 5 | 50 | YPGIeIESRL | 157.300 |
| 6 | 60 | GGTGaFEIEI | 88.000 |
| 7 | 33 | CGFEaTYLEL | 48.400 |
| 8 | 83 | FPYEkDLIEA | 31.460 |
| 9 | 80 | NGGFpYEKDL | 22.000 |
| 10 | 36 | EATYlELASA | 11.000 |
| 11 | 16 | EVEPgSGVRI | 8.800 |
| 12 | 96 | ASNGeTLEKI | 5.856 |
| 13 | 105 | ITNSrPPCVI | 5.200 |
| 14 | 37 | ATYLeLASAV | 4.000 |
| 15 | 1 | MSGEpGQTSV | 3.461 |
| 16 | 21 | SGVRiVVEYC | 2.420 |
| 17 | 58 | RLGGtGAFEI | 2.420 |
| 18 | 4 | EPGQtSVAPP | 2.200 |
| 19 | 8 | TSVApPPEEV | 2.200 |
| 20 | 2 | SGEPgQTSVA | 2.200 |

User Parameters and Scoring Information

| | |
|---|---|
| method selected to limit number of results | explicit number |
| number of results requested | 20 |
| HLA molecule type selected | B_5102 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 18 | EPGSGVRIV | 242.000 |
| 2 | 81 | GGFPYEKDL | 110.000 |
| 3 | 59 | LGGTGAFEI | 96.800 |
| 4 | 70 | NGQLVFSKL | 48.400 |
| 5 | 2 | SGEPGQTSV | 24.200 |
| 6 | 51 | PGIEIESRL | 13.200 |
| 7 | 83 | FPYEKDLIE | 11.000 |
| 8 | 97 | SNGETLEKI | 10.648 |
| 9 | 38 | TYLELASAV | 6.600 |
| 10 | 19 | PGSGVRIVV | 4.840 |
| 11 | 106 | TNSRPPCVI | 4.400 |
| 12 | 61 | GTGAFEIEI | 4.000 |
| 13 | 82 | GFPYEKDLI | 4.000 |
| 14 | 31 | EPCGFEATY | 3.630 |
| 15 | 63 | GAFEIEING | 2.750 |
| 16 | 36 | EATYLELAS | 2.500 |
| 17 | 50 | YPGIEIESR | 2.420 |
| 18 | 45 | AVKEQYPGI | 2.420 |
| 19 | 9 | SVAPPPEEV | 2.200 |
| 20 | 105 | ITNSRPPCV | 2.000 |

User Parameters and Scoring Information

| | |
|---|---|
| method selected to limit number of results | explicit number |
| number of results requested | 20 |
| HLA molecule type selected | B_5102 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 44 | SAVKeQYPGI | 726.000 |
| 2 | 50 | YPGIeIESRL | 400.000 |
| 3 | 81 | GGFPyEKDLI | 400.000 |
| 4 | 18 | EPGSgVRIVV | 220.000 |
| 5 | 31 | EPCGfEATYL | 121.000 |
| 6 | 33 | CGFEaTYLEL | 121.000 |

TABLE 2-continued

HLA peptide motif search results
("Start Position" = SEQ ID NO: 2 Start Position)
HLA peptide motif search results

| | | | |
|---|---|---|---|
| 7 | 83 | FPYEkDLIEA | 110.000 |
| 8 | 60 | GGTGaFEIEI | 88.000 |
| 9 | 80 | NGGFpYEKDL | 22.000 |
| 10 | 37 | ATYLeLASAV | 11.000 |
| 11 | 96 | ASNGeTLEKI | 10.648 |
| 12 | 21 | SGVRiVVEYC | 8.785 |
| 13 | 8 | TSVApPPEEV | 6.600 |
| 14 | 36 | EATYlELASA | 5.000 |
| 15 | 58 | RLGGtGAFEI | 4.840 |
| 16 | 16 | EVEPgSGVRI | 4.000 |
| 17 | 105 | ITNSrPPCVI | 4.000 |
| 18 | 65 | FEIEiNGQLV | 3.194 |
| 19 | 63 | GAFEiEINGQ | 3.025 |
| 20 | 1 | MSGEpGQTSV | 2.662 |

User Parameters and Scoring Information

| | |
|---|---|
| method selected to limit number of results | explicit number |
| number of results requested | 20 |
| HLA molecule type selected | B_5103 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 44 | SAVKeQYPGI | 110.000 |
| 2 | 81 | GGFPyEKDLI | 52.800 |
| 3 | 18 | EPGSgVRIVV | 44.000 |
| 4 | 60 | GGTGaFEIEI | 44.000 |
| 5 | 33 | CGFEaTYLEL | 7.920 |
| 6 | 37 | ATYLeLASAV | 6.600 |
| 7 | 31 | EPCGfEATYL | 6.600 |
| 8 | 83 | FPYEkDLIEA | 6.600 |
| 9 | 80 | NGGFpYEKDL | 6.000 |
| 10 | 50 | YPGIeIESRL | 6.000 |
| 11 | 36 | EATYlELASA | 5.000 |
| 12 | 21 | SGVRiVVEYC | 2.420 |
| 13 | 2 | SGEPgQTSVA | 2.420 |
| 14 | 1 | MSGEpGQTSV | 2.420 |
| 15 | 104 | KITNsRPPCV | 2.420 |
| 16 | 58 | RLGGtGAFEI | 2.420 |
| 17 | 96 | ASNGeTLEKI | 2.200 |
| 18 | 8 | TSVApPPEEV | 2.200 |
| 19 | 16 | EVEPgSGVRI | 2.200 |
| 20 | 105 | ITNSrPPCVI | 2.000 |

User Parameters and Scoring Information

| | |
|---|---|
| method selected to limit number of results | explicit number |
| number of results requested | 20 |
| HLA molecule type selected | B_5103 |
| length selected for subsequences to be scored | 10 |
| echoing mode selected for input sequence | Y |
| echoing format | numbered lines |
| length of user's input peptide sequence | 115 |

TABLE 2-continued

HLA peptide motif search results
("Start Position" = SEQ ID NO: 2 Start Position)
HLA peptide motif search results

| | |
|---|---|
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 44 | SAVKeQYPGI | 110.000 |
| 2 | 81 | GGFPyEKDLI | 52.800 |
| 3 | 18 | EPGSgVRIVV | 44.000 |
| 4 | 60 | GGTGaFEIEI | 44.000 |
| 5 | 33 | CGFEaTYLEL | 7.920 |
| 6 | 37 | ATYLeLASAV | 6.600 |
| 7 | 31 | EPCGfEATYL | 6.600 |
| 8 | 83 | FPYEkDLIEA | 6.600 |
| 9 | 80 | NGGFpYEKDL | 6.000 |
| 10 | 50 | YPGIeIESRL | 6.000 |
| 11 | 36 | EATYlELASA | 5.000 |
| 12 | 21 | SGVRiVVEYC | 2.420 |
| 13 | 2 | SGEPgQTSVA | 2.420 |
| 14 | 1 | MSGEpGQTSV | 2.420 |
| 15 | 104 | KITNsRPPCV | 2.420 |
| 16 | 58 | RLGGtGAFEI | 2.420 |
| 17 | 96 | ASNGeTLEKI | 2.200 |
| 18 | 8 | TSVApPPEEV | 2.200 |
| 19 | 16 | EVEPgSGVRI | 2.200 |
| 20 | 105 | ITNSrPPCVI | 2.000 |

User Parameters and Scoring Information

| | |
|---|---|
| method selected to limit number of results | explicit number |
| number of results requested | 20 |
| HLA molecule type selected | B_5801 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 75 | FSKLENGGF | 40.000 |
| 2 | 42 | LASAVKEQY | 4.500 |
| 3 | 107 | NSRPPCVIL | 4.000 |
| 4 | 61 | GTGAFEIEI | 3.000 |
| 5 | 105 | ITNSRPPCV | 3.000 |
| 6 | 37 | ATYLELASA | 2.400 |
| 7 | 1 | MSGEPGQTS | 0.880 |
| 8 | 67 | IEINGQLVF | 0.660 |
| 9 | 56 | ESRLGGTGA | 0.600 |
| 10 | 21 | SGVRIVVEY | 0.540 |
| 11 | 27 | VEYCEPCGF | 0.400 |
| 12 | 63 | GAFEIEING | 0.330 |
| 13 | 100 | ETLEKITNS | 0.317 |
| 14 | 95 | RASNGETLE | 0.300 |
| 15 | 20 | GSGVRIVVE | 0.240 |
| 16 | 96 | ASNGETLEK | 0.220 |
| 17 | 44 | SAVKEQYPG | 0.220 |
| 18 | 2 | SGEPGQTSV | 0.200 |

TABLE 2-continued

HLA peptide motif search results
("Start Position" = SEQ ID NO: 2 Start Position)
HLA peptide motif search results

| | | | |
|---|---|---|---|
| 19 | 10 | VAPPPEEVE | 0.200 |
| 20 | 57 | SRLGGTGAF | 0.200 |

User Parameters and Scoring Information

| | |
|---|---|
| method selected to limit number of results | explicit number |
| number of results requested | 20 |
| HLA molecule type selected | B_5801 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 56 | ESRLgGTGAF | 12.000 |
| 2 | 20 | GSGVrIVVEY | 10.800 |
| 3 | 1 | MSGEpGQTSV | 4.000 |
| 4 | 105 | ITNSrPPCVI | 3.000 |
| 5 | 37 | ATYLeLASAV | 3.000 |
| 6 | 96 | ASNGeTLEKI | 2.640 |
| 7 | 44 | SAVKeQYPGI | 2.000 |
| 8 | 8 | TSVApPPEEV | 2.000 |
| 9 | 74 | VFSKlENGGF | 0.800 |
| 10 | 61 | GTGAfEIEIN | 0.480 |
| 11 | 26 | VVEYcEPCGF | 0.400 |
| 12 | 36 | EATYlELASA | 0.360 |
| 13 | 95 | RASNgETLEK | 0.330 |
| 14 | 63 | GAFEiEINGQ | 0.264 |
| 15 | 83 | FPYEkDLIEA | 0.240 |
| 16 | 29 | YCEPcGFEAT | 0.240 |
| 17 | 33 | CGFEaTYLEL | 0.220 |
| 18 | 43 | ASAVkEQYPG | 0.220 |
| 19 | 75 | FSKLeNGGFP | 0.200 |
| 20 | 7 | QTSVaPPPEE | 0.200 |

User Parameters and Scoring Information

| | |
|---|---|
| method selected to limit number of results | explicit number |
| number of results requested | 20 |
| HLA molecule type selected | Cw_0301 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 65 | FEIEINGQL | 30.000 |
| 2 | 81 | GGFPYEKDL | 18.000 |
| 3 | 70 | NGQLVFSKL | 12.000 |
| 4 | 57 | SRLGGTGAF | 10.000 |
| 5 | 34 | GFEATYLEL | 10.000 |
| 6 | 94 | RRASNGETL | 5.760 |

TABLE 2-continued

HLA peptide motif search results
("Start Position" = SEQ ID NO: 2 Start Position)
HLA peptide motif search results

| | | | |
|---|---|---|---|
| 7 | 27 | VEYCEPCGF | 5.000 |
| 8 | 67 | IEINGQLVF | 5.000 |
| 9 | 107 | NSRPPCVIL | 2.000 |
| 10 | 51 | PGIEIESRL | 1.800 |
| 11 | 15 | EEVEPGSGV | 1.800 |
| 12 | 38 | TYLELASAV | 1.800 |
| 13 | 21 | SGVRIVVEY | 1.500 |
| 14 | 25 | IVVEYCEPC | 1.500 |
| 15 | 88 | DLIEAIRRA | 1.500 |
| 16 | 37 | ATYLELASA | 1.000 |
| 17 | 45 | AVKEQYPGI | 0.750 |
| 18 | 97 | SNGETLEKI | 0.750 |
| 19 | 106 | TNSRPPCVI | 0.750 |
| 20 | 29 | YCEPCGFEA | 0.500 |

User Parameters and Scoring Information

| | |
|---|---|
| method selected to limit number of results | explicit number |
| number of results requested | 20 |
| HLA molecule type selected | Cw_0301 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 44 | SAVKeQYPGI | 50.000 |
| 2 | 33 | CGFEaTYLEL | 45.000 |
| 3 | 69 | INGQlVFSKL | 12.000 |
| 4 | 81 | GGFPyEKDLI | 3.750 |
| 5 | 106 | TNSRpPCVIL | 3.000 |
| 6 | 29 | YCEPcGFEAT | 2.500 |
| 7 | 16 | EVEPgSGVRI | 2.500 |
| 8 | 65 | FEIEiNGQLV | 2.160 |
| 9 | 31 | EPCGfEATYL | 2.000 |
| 10 | 64 | AFEIeINGQL | 2.000 |
| 11 | 53 | IEIEsRLGGT | 1.500 |
| 12 | 83 | FPYEkDLIEA | 1.500 |
| 13 | 76 | SKLEnGGFPY | 1.500 |
| 14 | 21 | SGVRiVVEYC | 1.500 |
| 15 | 37 | ATYLeLASAV | 1.200 |
| 16 | 80 | NGGFpYEKDL | 1.200 |
| 17 | 50 | YPGIeIESRL | 1.200 |
| 18 | 93 | IRRAsNGETL | 1.152 |
| 19 | 23 | VRIVvEYCEP | 1.000 |
| 20 | 8 | TSVApPPEEV | 1.000 |

User Parameters and Scoring Information

| | |
|---|---|
| method selected to limit number of results | explicit number |
| number of results requested | 20 |
| HLA molecule type selected | Cw_0401 |
| length selected for subsequences to be scored | 9 |
| echoing mode selected for input sequence | Y |
| echoing format | numbered lines |
| length of user's input peptide sequence | 115 |

TABLE 2-continued

HLA peptide motif search results
("Start Position" = SEQ ID NO: 2 Start Position)
HLA peptide motif search results

| | |
|---|---|
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 34 | GFEATYLEL | 240.000 |
| 2 | 38 | TYLELASAV | 30.000 |
| 3 | 82 | GFPYEKDLI | 25.000 |
| 4 | 18 | EPGSGVRIV | 20.000 |
| 5 | 31 | EPCGFEATY | 12.000 |
| 6 | 81 | GGFPYEKDL | 4.800 |
| 7 | 107 | NSRPPCVIL | 4.800 |
| 8 | 70 | NGQLVFSKL | 4.400 |
| 9 | 75 | FSKLENGGF | 2.000 |
| 10 | 97 | SNGETLEKI | 1.584 |
| 11 | 64 | AFEIEINGQ | 1.000 |
| 12 | 84 | PYEKDLIEA | 1.000 |
| 13 | 49 | QYPGIEIES | 1.000 |
| 14 | 21 | SGVRIVVEY | 1.000 |
| 15 | 2 | SGEPGQTSV | 0.660 |
| 16 | 28 | EYCEPCGFE | 0.600 |
| 17 | 45 | AVKEQYPGI | 0.600 |
| 18 | 9 | SVAPPPEEV | 0.600 |
| 19 | 105 | ITNSRPPCV | 0.550 |
| 20 | 77 | KLENGGFPY | 0.500 |

User Parameters and Scoring Information

| | |
|---|---|
| method selected to limit number of results | explicit number |
| number of results requested | 20 |
| HLA molecule type selected | Cw_0401 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 64 | AFEIEeINGQL | 200.000 |
| 2 | 74 | VFSKlENGGF | 100.000 |
| 3 | 50 | YPGIeIESRL | 80.000 |
| 4 | 31 | EPCGfEATYL | 80.000 |
| 5 | 18 | EPGSgVRIVV | 10.000 |
| 6 | 34 | GFEAtYLELA | 10.000 |
| 7 | 28 | EYCEpCGFEA | 6.000 |
| 8 | 33 | CGFEaTYLEL | 5.760 |
| 9 | 84 | PYEKdLIEAI | 5.000 |
| 10 | 83 | FPYEkDLIEA | 4.800 |
| 11 | 69 | INGQlVFSKL | 4.400 |
| 12 | 80 | NGGFpYEKDL | 4.000 |
| 13 | 106 | TNSRpPCVIL | 4.000 |
| 14 | 56 | ESRLgGTGAF | 2.000 |
| 15 | 66 | EIEInGQLVF | 2.000 |
| 16 | 26 | VVEYcEPCGF | 2.000 |
| 17 | 96 | ASNGeTLEKI | 1.320 |
| 18 | 49 | QYPGiEIESR | 1.100 |
| 19 | 20 | GSGVrIVVEY | 1.000 |
| 20 | 38 | TYLElASAVK | 0.792 |

User Parameters and Scoring Information

| | |
|---|---|
| method selected to limit number of results | explicit number |
| number of results requested | 20 |
| HLA molecule type selected | Cw_0602 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 85 | YEKDLIEAI | 6.600 |
| 2 | 65 | FEIEINGQL | 6.600 |
| 3 | 21 | SGVRIVVEY | 6.000 |
| 4 | 31 | EPCGFEATY | 3.300 |
| 5 | 61 | GTGAFEIEI | 3.000 |
| 6 | 38 | TYLELASAV | 3.000 |
| 7 | 18 | EPGSGVRIV | 2.420 |
| 8 | 81 | GGFPYEKDL | 2.200 |
| 9 | 94 | RRASNGETL | 2.200 |
| 10 | 97 | SNGETLEKI | 2.000 |
| 11 | 70 | NGQLVFSKL | 2.000 |
| 12 | 34 | GFEATYLEL | 2.000 |
| 13 | 107 | NSRPPCVIL | 2.000 |
| 14 | 105 | ITNSRPPCV | 1.100 |
| 15 | 47 | KEQYPGIEI | 1.100 |
| 16 | 66 | EIEINGQLV | 1.100 |
| 17 | 42 | LASAVKEQY | 1.100 |
| 18 | 77 | KLENGGFPY | 1.100 |
| 19 | 15 | EEVEPGSGV | 1.000 |
| 20 | 45 | AVKEQYPGI | 1.000 |

User Parameters and Scoring Information

| | |
|---|---|
| method selected to limit number of results | explicit number |
| number of results requested | 20 |
| HLA molecule type selected | Cw_0702 |
| length selected for subsequences to be scored | 9 |
| echoing mode selected for input sequence | Y |
| echoing format | numbered lines |
| length of user's input peptide sequence | 115 |
| number of subsequence scores calculated | 107 |
| number of top-scoring subsequences reported back in scoring output table | 20 |

Scoring Results

| Rank | Start Position | Subsequence Residue Listing | Score (Estimate of Half Time of Disassociation of a Molecule Containing This Subsequence |
|---|---|---|---|
| 1 | 31 | EPCGFEATY | 24.000 |
| 2 | 21 | SGVRIVVEY | 19.200 |
| 3 | 42 | LASAVKEQY | 8.800 |
| 4 | 77 | KLENGGFPY | 4.000 |
| 5 | 49 | QYPGIEIES | 2.880 |
| 6 | 57 | SRLGGTGAF | 2.400 |

TABLE 2-continued

HLA peptide motif search results
("Start Position" = SEQ ID NO: 2 Start Position)
HLA peptide motif search results

| | | | |
|---|---|---|---|
| 7 | 18 | EPGSGVRIV | 2.400 |
| 8 | 94 | RRASNGETL | 2.400 |
| 9 | 85 | YEKDLIEAI | 1.478 |
| 10 | 34 | GFEATYLEL | 1.440 |
| 11 | 38 | TYLELASAV | 1.440 |
| 12 | 70 | NGQLVFSKL | 1.440 |
| 13 | 65 | FEIEINGQL | 1.200 |
| 14 | 81 | GGFPYEKDL | 1.008 |
| 15 | 67 | IEINGQLVF | 1.000 |
| 16 | 97 | SNGETLEKI | 0.960 |
| 17 | 61 | GTGAFEIEI | 0.960 |
| 18 | 107 | NSRPPCVIL | 0.840 |
| 19 | 22 | GVRIVVEYC | 0.800 |
| 20 | 35 | FEATYLELA | 0.800 |

User Parameters and Scoring Information

| | |
|---|---|
| method selected to limit number of results | explicit number |
| number of results requested | 20 |
| HLA molecule type selected | Cw_0702 |
| length selected for subsequences to be scored | 10 |
| echoing mode selected for input sequence | Y |
| echoing format | numbered lines |
| length of user's input peptide sequence | 115 |
| number of subsequence scores calculated | 106 |
| number of top-scoring subsequences reported back in scoring output table | 20 |

TABLE 2-continued

HLA peptide motif search results
("Start Position" = SEQ ID NO: 2 Start Position)
HLA peptide motif search results Scoring Results

| Rank | Start Position | Subsequence Residue Listing | Score (Estimate of Half Time of Disassociation of a Molecule Containing This Subsequence |
|---|---|---|---|
| 1 | 20 | GSGVrIVVEY | 38.400 |
| 2 | 30 | CEPCgFEATY | 16.000 |
| 3 | 41 | ELASaVKEQY | 16.000 |
| 4 | 50 | YPGIeIESRL | 7.920 |
| 5 | 76 | SKLEnGGFPY | 4.000 |
| 6 | 69 | INGQlVFSKL | 2.880 |
| 7 | 18 | EPGSgVRIVV | 2.400 |
| 8 | 33 | CGFEaTYLEL | 1.440 |
| 9 | 80 | NGGFpYEKDL | 1.440 |
| 10 | 56 | ESRLgGTGAF | 1.200 |
| 11 | 93 | IRRAsNGETL | 1.200 |
| 12 | 64 | AFEIeINGQL | 1.200 |
| 13 | 66 | EIEInGQLVF | 1.000 |
| 14 | 35 | FEATyLELAS | 0.960 |
| 15 | 87 | KDLIeAIRRA | 0.800 |
| 16 | 97 | SNGEtLEKIT | 0.800 |
| 17 | 17 | VEPGsGVRIV | 0.800 |
| 18 | 21 | SGVRiVVEYC | 0.800 |
| 19 | 28 | EYCEpCGFEA | 0.720 |
| 20 | 48 | EQYPgIEIES | 0.672 |

Echoed User Peptide Sequence
(length = 115 residues)

TABLE 3

File Name: C35

Prediction Parameters:
Quantitative Threshold [%]: 3
Inhibitor Threshold [log of fold change]: -1
Inhibitor Residues [number]: 1

0--------30----
DRB1*0101: SGVRIVVEYCEPCGF (amino acids 21-35 of SEQ ID NO: 2)

DRB1*0301: SGVRIVVEYCEPCGF

DRB1*0401: SGVRIVVEYCEPCGF

DRB1*0701: SGVRIVVEYCEPCGF

DRB1*0801: SGVRIVVEYCEPCGF

DRB1*1101: SGVRIVVEYCEPCGF

DRB1*1501: SGVRIVVEYCEPCGF

DRB5*0101: S~~GVRIVVEYCE~~PCGF (binding frame for B5*0101 contains 1 inhibitory residue -100 fold)
Quantitative Analysis of 'SGVRIVVEYCEPCGF' (amino acids 21-35 of SEQ ID NO: 2)
Threshold (%): 10 09 08 07 06 05 04 03 02 01
DRB1*0101 XXXXXXXXXXXXXXXXXXXXXXXXXXXXXXXXXXX....

DRB1*0102 XXXXXXXXXXXXXXXXXXXXXXXXXXXXXXXXXXX....

DRB1*0301 XXXXXXXXXXXXXXXXXX....................

DRB1*0401 XXXXXXXXXXXXXXXXXXXXXXXXXXXXXXXXXXXXXXX

DRB1*0402 XX....................................

DRB1*0404 XXXXXXXXXXXXXXXXXX....................

TABLE 3-continued

DRB1*0405 XXXXXXXXXXXXXXXXXXXXXXXXXX............

DRB1*0410 XXXXXXXXXXXXXXXXXXXXXXXXXXXXXX........

DRB1*0421 XXXXXXXXXXXXXXXXXXXXXXXXXXXXXXXXXX....

DRB1*0701 XXXXXXXXXX............................

DRB1*0801 XXXXXXXXXXXXXXXXXXXXXXXXXX............

DRB1*0802 XXXXXX................................

DRB1*0804 XXXXXXXXXXXXXX........................

DRB1*0806 XXXXXXXXXXXXXXXXXXXXXXXXXXXXXX........

DRB1*1101 XXXXXXXXXX............................

DRB1*1104 XXXXXXXXXX............................

DRB1*1106 XXXXXXXXXX............................

DRB1*1107 XXXXXXXXXXXXXXXXXX....................

DRB1*1305 XXXXXXXXXXXXXXXXXX....................

DRB1*1307 XXXXXXXXXX............................

DRB1*1311 XXXXXXXXXX............................

DRB1*1321 XXXXXXXXXXXXXXXXXXXXXXXXXXXXXX........

DRB1*1501 XXXXXXXXXX............................

DRB1*1502 XXXXXXXXXX............................

DRB5*0101 XXXXXXXXXXXXXXXXXXXXXXXXXXXXXX........

File Name: C35

Prediction Parameters:
Quantitative Threshold [%]: 3
Inhibitor Threshold [log of fold change]: -1
Inhibitor Residues [number]: 1

---60--------70----
DRB1*0101: SRLGGTGAFEIEINGQLVF (amino acids 57-75 of SEQ ID NO: 2)

DRB1*0301: SRLGGTGAFEIEINGQLVF

DRB1*0401: SRLGGTGA~~FEIEINGQL~~VF

DRB1*0701: SRLGGTGAFEIEINGQLVF

DRB1*0801: SRLGGTGAFEIEINGQLVF

DRB1*1101: SRLGGTGAFEIEINGQLVF

DRB1*1501: SRLGGTGAFEIEINGQLVF

DRB5*0101: SRLGGTGAFEIEINGQLVF (binding frame for *0401 contains 2 inhibitory residues -10 fold each)
Quantitative Analysis of 'SRLGGTGAFEIEINGQLVF' (amino acids 57-75 of SEQ ID NO: 2)
Threshold (%): 10 09 08 07 06 05 04 03 02 01
DRB1*0101 XXXXXXXXXXXXXXXXXXXXXX................

DRB1*0102 XXXXXXXXXXXXXXXXXXXXXXXXXX............

DRB1*0301 XXXXXXXXXXXXXXXXXXXXXX................

DRB1*0401 XXXXXXXXXXXXXXXXXXXXXXXXXXXXXXXXXX....

DRB1*0402 XXXXXXXXXX............................

DRB1*0404 ......................................

DRB1*0405 XXXXXXXXXX............................

TABLE 3-continued

DRB1*0410 XX....................................

DRB1*0421 XXXXXXXXXXXXXXXXXXXXXXXXXXXXXXXXXX....

DRB1*0701 XXXXXXXXXXXXXXXXXXXXXXXXXXXXXXXXXXXXXX

DRB1*0801 ......................................

DRB1*0802 ......................................

DRB1*0804 XXXXXX................................

DRB1*0806 XXXXXX................................

DRB1*1101 XXXXXXXXXXXXXXXXXXXXXX................

DRB1*1104 XXXXXXXXXXXXXXXXXXXXXXXXXX............

DRB1*1106 XXXXXXXXXXXXXXXXXXXXXXXXXX............

DRB1*1107 XX....................................

DRB1*1305 XXXXXXXXXXXXXXXXXXXXXXXXXXXXXX........

DRB1*1307 XX....................................

DRB1*1311 XXXXXXXXXXXXXXXXXXXXXXXXXX............

DRB1*1321 XXXXXXXXXXXXXXXXXXXXXX................

DRB1*1501 XXXXXXXXXXXXXXXXXX....................

DRB1*1502 XXXXXXXXXXXXXXXXXX....................

DRB5*0101 XXXXXXXXXXXXXXXXXXXXXXXXXXXXXX........

File Name: C35

Prediction Parameters:
Quantitative Threshold [%]: 3
Inhibitor Threshold [log of fold change]: -1
Inhibitor Residues [number]: 1

-------70--------80--

DRB1*0101: GAFEIEINGQLVFSKLENGGF (amino acids 63-83 of SEQ ID NO: 2)

DRB1*0301: GAFEIEINGQLVFSKLENGGF

DRB1*0401: GA~~FEIEINGQL~~FSKLENGGF

DRB1*0701: GAFEIEINGQLVFSKLENGGF

DRB1*0801: GAFEIEINGQLVFSKLENGGF

DRB1*1101: GAFEIEINGQLVFSKLENGGF

DRB1*1501: GAFEIEINGQLVFSKLENGGF

DRB5*0101: GAFEIEINGQLVFSKLENGGF (binding frame for *0401 contains 2 inhibitory residues -10 fold each)
Quantitative Analysis of 'GAFEIEINGQLVFSKLENGGF' (amino acids 63-83 of SEQ ID NO: 2)

Threshold (%): 10 09 08 07 06 05 04 03 02 01

DRB1*0101 XXXXXXXXXXXXXXXXXX....................

DRB1*0102 XXXXXXXXXXXXXX........................

DRB1*0301 XXXXXXXXXXXXXXXXXXXXXXXXXXXXXXXXXX....

DRB1*0401 XXXXXXXXXXXXXXXXXXXXXXXXXXXXXXXXXX....

DRB1*0402 XXXXXXXXXXXXXXXXXXXXXXXXXX............

DRB1*0404 XXXXXXXXXXXXXXXXXXXXXXXXXX............

DRB1*0405 XXXXXXXXXX............................

DRB1*0410 XXXXXX................................

TABLE 3-continued

DRB1*0421 XXXXXXXXXXXXXXXXXXXXXXXXXXXXXXXXXX....

DRB1*0701 XXXXXXXXXXXXXXXXXX....................

DRB1*0801 ......................................

DRB1*0802 ......................................

DRB1*0804 XXXXXX................................

DRB1*0806 XXXXXX................................

DRB1*1101 XXXXXXXXXXXXXXXXXXXXXX................

DRB1*1104 XXXXXXXXXXXXXXXXXXXXXXXXXX............

DRB1*1106 XXXXXXXXXXXXXXXXXXXXXXXXXX............

DRB1*1107 XXXXXXXXXXXXXXXXXXXXXXXXXXXXXXXXXX....

DRB1*1305 XXXXXXXXXXXXXXXXXXXXXXXXXXXXXX........

DRB1*1307 XXXXXXXXXXXXXXXXXX....................

DRB1*1311 XXXXXXXXXXXXXXXXXXXXXXXXXX............

DRB1*1321 XXXXXXXXXXXXXXXXXXXXXX................

DRB1*1501 XXXXXXXXXXXXXX........................

DRB1*1502 XXXXXXXXXXXXXX........................

DRB5*0101 XXXXXXXXXXXXXXXXXXXXXXXXXX............

File Name: C35

Prediction Parameters:
Quantitative Threshold [%]: 5
Inhibitor Threshold [log of fold change]: -1
Inhibitor Residues [number]: 1

-------90--------100-

DRB1*0101: FPYEKDLIEAIRRASNGETLE (amino acids 83-103 of SEQ ID NO: 2)

DRB1*0301: FPYEKDLIEAIRRASNGETLE

DRB1*0401: FPYEKDLIEA ~~IRRASNGET~~LE

DRB1*0701: FPYEKDLIEAIRRASNGETLE

DRB1*0801: FPYEKDLIEAIRRASNGETLE

DRB1*1101: FPYEKDLIEAIRRASNGETLE

DRB1*1501: FPYEKDLIEAIRRASNGETLE

DRB5*0101: FPYEKDLIEAIRRASNGETLE

Quantitative Analysis of 'FPYEKDLIEAIRRASNGETLE' (amino acids 83-103 of SEQ ID NO: 2)

Threshold (%): 10 09 08 07 06 05 04 03 02 01

DRB1*0101 XXXXXXXXXXXXXXXXXX....................

DRB1*0102 XXXXXXXXXXXXXXXXXXXXXXXXXX............

DRB1*0301 XXXXXXXXXXXXXXXXXXXXXX................

DRB1*0401 XXXXXXXXXXXXXXXXXXXXXXXXXX............

DRB1*0402 XXXXXXXXXXXXXXXXXX....................

DRB1*0404 XXXXXXXXXXXXXXXXXXXXXXXXXX............

DRB1*0405 XXXXXXXXXXXXXXXXXXXXXXXXXX............

DRB1*0410 XXXXXXXXXXXXXXXXXXXXXXXXXXXXXX........

DRB1*0421 XXXXXXXXXXXXXXXXXXXXXXXXXX............

DRB1*0701 XXXXXXXXXX............................

TABLE 3-continued

| | |
|---|---|
| DRB1*0801 | XXXXXXXXXXXXXXXXXX.................... |
| DRB1*0802 | XXXXXXXXXXXXXXXXXX.................... |
| DRB1*0804 | XXXXXXXXXXXXXXXXXXXXXX................ |
| DRB1*0806 | XXXXXXXXXXXXXXXXXXXXXX................ |
| DRB1*1101 | XXXXXXXXXX............................ |
| DRB1*1104 | XXXXXXXXXXXXXXXXXX.................... |
| DRB1*1106 | XXXXXXXXXXXXXXXXXX.................... |
| DRB1*1107 | XXXXXXXXXXXXXXXXXXXXXX................ |
| DRB1*1305 | XXXXXX................................ |
| DRB1*1307 | XXXXXXXXXXXXXXXXXXXXXX................ |
| DRB1*1311 | XXXXXXXXXXXXXXXXXX.................... |
| DRB1*1321 | XXXXXXXXXXXXXXXXXXXXXX................ |
| DRB1*1501 | XXXXXXXXXXXXXXXXXXXXXXXXXXXXXX........ |
| DRB1*1502 | XXXXXXXXXXXXXXXXXXXXXXXXXXXXXX........ |
| DRB5*0101 | XXXXXXXXXXXXXX........................ |

IMPORTANT NOTE:
Tepitope was programmed to evaluate Cys residues as Ala, sence for synthesis and assay limitations it was not possible to systematically test peptides containing Cys. So, whenever the predicted sequences contain Cys residues, we suggest you should have them synthesized REPLACING Cys WITH Ala RESIDUES.

Altered Peptide Ligands

Identification of immunodominant epitopes of C35 for MHC class I antigens using specific human T cell lines is a key step toward their successful use in cancer vaccines. Modified C35 peptide epitopes containing amino acid substitutions at MHC binding residues have the potential to be used for enhancement of immune function. Such altered peptide ligand, or heteroclitic peptides, can become strong T cell agonists even at 100-fold lower concentrations that the original peptide (Dressel, A. et al., "Autoantigen recognition by human CD8 T Cell clones: enhanced agonist response induced by altered peptide ligand," *J. Immunol.* 159:4943-51 (1997). These altered peptide ligand can be of two forms: those modifications that enhance T cell receptor contact with the peptide (must be determined experimentally) and those that enhance HLA binding of the peptide by improving the anchor residues. Table 4 specifies modifications that enhance HLA Class I binding by introducing favorable anchor residues or replacing deleterious residues.

TABLE 4

| Modifications that Enhance HLA Class I Binding (Unless otherwise indicated, examples apply to peptides of 9 amino acids; for 10-mers the amino acid at position 5 is disregarded and the resultant 9-mer is evaluated (http://bimas.dcrt.nih.gov/cgi-bin/molbio/hla_coefficient viewing_page. The modifications listed below are provided by way of example based on current data in existing databases and are not intended in any way to be an inclusive list of all potential alterations of peptides binding all potential HLA molecules, both known and unknown to date.) |
|---|
| HLA A*0101 |
| Any altered peptide that has S or T at position 2 |
| Any altered peptide that has D or E at position 3 |
| Any altered peptide that has P at position 4 |
| Any altered peptide that has A, F, I, L, M, P, V, or Y at position 7 |
| Any altered peptide that has F, K, R, or Y at anchor position 9 |
| Any altered peptide where deleterious residues at the following positions are replaced: |
| P1: P |
| P2: D, E, F, G, H, K, M, N, P, Q, R, W, Y |
| P3: E, K, R, W |
| P4: K, R |
| P7: D, E, G, R |
| P9: D, E, P |
| HLA A*0201 |
| Any altered peptide that has F, I, K, L, M, V, W, or Y at position 1 |
| Any altered peptide that has I, L, M, Q, or V at anchor position 2 |
| Any altered peptide that has F, L, M, W, or Y at position 3 |
| Any altered peptide that has D or E at position 4 |
| Any altered peptide that has F at position 5 |
| Any altered peptide that has F, I, L, M, V, W or Y at auxiliary anchor position 6 |
| Any altered peptide that has F, or W at position 7 |
| Any altered peptide that has F, W, or Y at position 8 |
| Any altered peptide that has I, L, T or V at anchor position 9 |
| Any altered peptide where deleterious residues at the following positions are replaced: |
| P1: D, E, H, P |
| P2: C, F, H, K, N, P, R, S, W, Y |
| P3: D, E, K, R |

TABLE 4-continued

| Modifications that Enhance HLA Class I Binding (Unless otherwise indicated, examples apply to peptides of 9 amino acids; for 10-mers the amino acid at position 5 is disregarded and the resultant 9-mer is evaluated (http://bimas.dcrt.nih.gov/cgi-bin/molbio/hla_coefficient viewing_page. The modifications listed below are provided by way of example based on current data in existing databases and are not intended in any way to be an inclusive list of all potential alterations of peptides binding all potential HLA molecules, both known and unknown to date.) |
|---|
| P7: D, E, G, R<br>P8: I, V<br>P9: D, E, F, G, H, K, N, P, Q, R, S, W, Y |
| HLA-A*0205 |
| Any altered peptide that has F, I, K, L, M, V, W, or Y at position 1<br>Any altered peptide that has E, I, L, M, Q, or V at anchor position 2<br>Any altered peptide that has F, L, M, W, or Y at position 3<br>Any altered peptide that has D or E at position 4<br>Any altered peptide that has F, Y at position 5<br>Any altered peptide that has F, I, L, M, V, W or Y at auxiliary anchor position 6<br>Any altered peptide that has F, or W at position 7<br>Any altered peptide that has F, W, or Y at position 8<br>Any altered peptide that has I, L, T or V at anchor position 9<br>Any altered peptide where deleterious residues at the following positions are replaced:<br>P1: D, E, P<br>P2: C, D, F, G, H, K, N, P, R, S, W, Y<br>P3: D, E, K, R<br>P7: D, E, R<br>P9: D, E, F, G, H, K, N, P, Q, R, S, W, Y |
| HLA-A*03 |
| Any altered peptide that has G or K at position 1<br>Any altered peptide that has I, L, M, Q, T or V at anchor position 2<br>Any altered peptide that has F, I, L, M, V, W, or Y at position 3<br>Any altered peptide that has E, G or P at position 4<br>Any altered peptide that has F, I, P, V, W, Y at position 5<br>Any altered peptide that has F, I, L, M, or V at position 6<br>Any altered peptide that has F, I, L, M, W, or Y at position 7<br>Any altered peptide that has F, I, K, L, Q or Y at anchor position 9<br>Any altered peptide where deleterious residues at the following positions are replaced:<br>P1: D, E, P<br>P2: D, E, F, G, H, K, N, R, S, W, Y<br>P7: G, K, R<br>P9: D, E, G, H, N, P, Q, S, T |
| HLA-A*1101 |
| Any altered peptide that has G, K or R at position 1<br>Any altered peptide that has I, L, M, Q, T, V, Y at anchor position 2<br>Any altered peptide that has F, I, L, M, V, W, Y at position 3<br>Any altered peptide that has F, I, L, M, W or Y at position 7<br>Any altered peptide that has K or R at anchor position 9<br>Any altered peptide where deleterious residues at the following positions are replaced:<br>P1: D, E, P<br>P2: D, E, G, H, K, N, R, S, W<br>P7: K, R<br>P9: C, D, E, G, N, P, Q, S, T |
| HLA-A24 |
| Any altered peptide that has K or R at position 1<br>Any altered peptide that has F or Y at anchor position 2<br>Any altered peptide that has E, I, L, M, N, P, Q, or Vat position 3<br>Any altered peptide that has D, E, or P at position 4<br>Any altered peptide that has I, L, or V at position 5<br>Any altered peptide that has F at position 6<br>Any altered peptide that has N or Q at position 7<br>Any altered peptide that has E or K at position 8<br>Any altered peptide that has F, I, L, or M at anchor position 9<br>Any altered peptide where deleterious residues at the following positions are replaced:<br>P1: P<br>P2: D, E, H, K, R<br>P9: D, E, G, H, K, P, Q, R |

TABLE 4-continued

| Modifications that Enhance HLA Class I Binding (Unless otherwise indicated, examples apply to peptides of 9 amino acids; for 10-mers the amino acid at position 5 is disregarded and the resultant 9-mer is evaluated (http://bimas.dcrt.nih.gov/cgi-bin/molbio/hla_coefficient viewing_page. The modifications listed below are provided by way of example based on current data in existing databases and are not intended in any way to be an inclusive list of all potential alterations of peptides binding all potential HLA molecules, both known and unknown to date.) |
|---|
| HLA-A*3101 |
| Any altered peptide that has K or R at position 1<br>Any altered peptide that has F, I, L, M, Q, T, V, or Y at anchor position 2<br>Any altered peptide that has F, I, L, M, V W, or Y at position 3<br>Any altered peptide that has F, I, L, M, or V at position 6<br>Any altered peptide that has F, I, L, M, W, or Y at position 7<br>Any altered peptide that has K or R at anchor position 9<br>Any altered peptide where deleterious residues at the following positions are replaced:<br>P1: D, E, P<br>P2: D, E, G, H, K, N, R, S<br>P7: K, R<br>P9: C, G, N, P, Q, S, T |
| HLA-A*3302 |
| Any altered peptide that has D or E at position 1<br>Any altered peptide that has I, L, M, S, V or Y at anchor position 2<br>Any altered peptide that has R at anchor position 9<br>Any altered peptide where deleterious residues at the following positions are replaced:<br>P1: K, P, R<br>P2: D, E, K, R<br>P9: D, E, F, G, N, P, W, Y |
| HLA-B7 |
| Any altered peptide that has A at position 1<br>Any altered peptide that has A, P or V at anchor position 2<br>Any altered peptide that has M or R at position 3<br>Any altered peptide that has P at position 5<br>Any altered peptide that has R at position 6<br>Any altered peptide that has I, L, M or V at anchor position 9<br>Any altered peptide where deleterious residues at the following positions are replaced:<br>P1: P<br>P2: D, E, F, H, K, R, W, Y<br>P3: D, E<br>P9: D, E, F, G, H, K, N, P, Q, R, S, W, Y |
| HLA-B8 |
| Any altered peptide that has D or E at position 1<br>Any altered peptide that has A, C, L, or P at anchor position 2<br>Any altered peptide that has K or R at position 3<br>Any altered peptide that has D or E at position 4<br>Any altered peptide that has K or R at position 5<br>Any altered peptide that has I, L, M, or V at anchor position 9<br>Any altered peptide where deleterious residues at the following positions are replaced:<br>P1: K, P, R<br>P2: D, E, F, G, H, K, Q, R, W, or Y<br>P3: D, E<br>P5: D, E<br>P9: D, E, F, G, H, K, N, P, Q, R, S, W, Y |
| HLA-B8 (8-mer peptides) |
| Any altered peptide that has D or E at position 1<br>Any altered peptide that has A, C, L, or P at anchor position 2<br>Any altered peptide that has K or R at position 3<br>Any altered peptide that has D or E at position 4<br>Any altered peptide that has K or R at position 5<br>Any altered peptide that has I, L, M, or V at anchor position 8<br>Any altered peptide where deleterious residues at the following positions are replaced:<br>P1: K, P, R<br>P2: D, E, F, G, H, K, Q, R, W, or Y |

TABLE 4-continued

Modifications that Enhance HLA Class I Binding
(Unless otherwise indicated, examples apply to peptides of 9 amino acids; for 10-mers the amino acid at position 5 is disregarded and the resultant 9-mer is evaluated (http://bimas.dcrt.nih.gov/cgi-bin/molbio/hla_coefficient viewing_page. The modifications listed below are provided by way of example based on current data in existing databases and are not intended in any way to be an inclusive list of all potential alterations of peptides binding all potential HLA molecules, both known and unknown to date.)

P3: D, E
P5: D, E
P8: D, E, F, G, H, K, N, P, Q, R, S, W, Y

HLA-B14

Any altered peptide that has D or E at position 1
Any altered peptide that has K or R at anchor position 2
Any altered peptide that has F, I, L, M, P, V, W, Y at position 3
Any altered peptide that has H or R at position 5
Any altered peptide that has I, L, M, R, or V at position 6
Any altered peptide that has T at position 7
Any altered peptide that has I, L, M, or V at anchor position 9
Any altered peptide where deleterious residues at the following positions are replaced:
P1: P
P2: D, E, F, W, or Y
P3: E, R
P5: E, W, Y
P9: D, E, G, H, K, N, P, Q, R

HLA-B*2702

Any altered peptide that has K or R at position 1
Any altered peptide that has E, L, M, N, Q or R at anchor position 2
Any altered peptide that has F, W, or Y at position 3
Any altered peptide that has F, I, L, W or Y at anchor position 9
Any altered peptide where deleterious residues at the following positions are replaced:
P1: D, E, P
P2: D, F, G, H, K, W, or Y
P7: K
P9: D, E, G, K, N, P, Q, R, S HLA-B27*05 (8-mer peptides)

Any altered peptide that has K or R at position 1
Any altered peptide that has E, L, M, N, Q or R at anchor position 2
Any altered peptide that has F, W, or Y at position 3
Any altered peptide that has F, I, K, L, M, R, V or Y at anchor position 8
Any altered peptide where deleterious residues at the following positions are replaced:
P1: D, E, P
P2: D, F, G, H, K, W, or Y
P7: K
P9: D, E, G, K, N, P, Q, R, S HLA-B*3501 (8-mer peptides)

Any altered peptide that has K or R at position 1
Any altered peptide that has A, P, or S at anchor position 2
Any altered peptide that has K or R at position 3
Any altered peptide that has D or E at position 4
Any altered peptide that has D or E at position 5
Any altered peptide that has F, I, L, M, V, W or Y at anchor position 8
Any altered peptide where deleterious residues at the following positions are replaced:
P1: P
P2: D, E, F, H, K, R, W, Y
P3: D, E
P8: D, E, F, G, H, K, P, Q, R

HLA-B*3701

Any altered peptide that has D or E at anchor position 2
Any altered peptide that has I or V at position 5
Any altered peptide that has F, L, or M at position 8
Any altered peptide that has F, I, L, M, V or Y at anchor position 9
Any altered peptide where deleterious residues at the following positions are replaced:
P1: P
P9: D, E, G, H, K, P, Q, R TABLE 4-continued Modifications that Enhance HLA Class I Binding
(Unless otherwise indicated, examples apply to peptides of 9 amino acids; for 10-mers the amino acid at position 5 is disregarded and the resultant 9-mer is evaluated (http://bimas.dcrt.nih.gov/cgi-bin/molbio/hla_coefficient viewing_page. The modifications listed below are provided by way of example based on current data in existing databases and are not intended in any way to be an inclusive list of all potential alterations of peptides binding all potential HLA molecules, both known and unknown to date.)

HLA-B*3801

Any altered peptide that has F, H, P, W or Y at anchor position 2
Any altered peptide that has D or E at position 3
Any altered peptide that has D, E, or G at position 4
Any altered peptide that has A, I, L, M, or V at position 5
Any altered peptide that has K or Y at position 8
Any altered peptide that has F, I, L, M, or V at anchor position 9
Any altered peptide where deleterious residues at the following positions are replaced:
P1: P
P2: D, E, K, R
P3: K, R
P9: D, E, G, H, K, P, Q, R HLA-B*3901 (8-mer peptides)

Any altered peptide that has H or R at anchor position 2
Any altered peptide that has D, E, F, I, L, M, V, W, or W at position 3
Any altered peptide that has D or E at position 4
Any altered peptide that has I, L, M, or V at position 6
Any altered peptide that has I, L, M or V at anchor position 8
Any altered peptide where deleterious residues at the following positions are replaced:
P1: P
P2: D, E
P3: K, R
P6: D, E, K, R
P8: D, E, G, H, K, P, Q, R

HLA-B*3902

Any altered peptide that has K or Q at anchor position 2
Any altered peptide that has F, I, L, M, V, W, or Y at position 5
Any altered peptide that has F, L, or M at anchor position 9
Any altered peptide where deleterious residues at the following positions are replaced:
P1: P
P2: D, E
P3: K, R
P9: D, E, G, H, K, P, Q, R

HLA-B40

Any altered peptide that has A or G at position 1
Any altered peptide that has D or E at anchor position 2
Any altered peptide that has A, F, I, L, M, V, W, or Y at position 3
Any altered peptide that has P at position 4
Any altered peptide that has P at position 5
Any altered peptide that has A, L, M, or W at anchor position 9
Any altered peptide where deleterious residues at the following positions are replaced:
P1: P
P2: F, H, I, K, L, M, Q, R, V, W, or Y
P3: D, E, K, R
P9: D, E, G, H, K, N, P, Q, R

HLA-B44*03

Any altered peptide that has A, D, or S at position 1
Any altered peptide that has D or E at anchor position 2
Any altered peptide that has A, I, L, M, or V at position 3
Any altered peptide that has F, I, or P at position 4
Any altered peptide that has A, K, or V at position 5
Any altered peptide that has A, L, T, or V at position 6
Any altered peptide that has F, K, or T at position 7
Any altered peptide that has K at position 8
Any altered peptide that has F, W or Y at anchor position 9
Any altered peptide where deleterious residues at the following positions are replaced:
P1: P
P2: F, H, I, K, L, M, Q, R, V, W, Y
P9: D, E, G, H, K, N, P, Q, R TABLE 4-continued

| Modifications that Enhance HLA Class I Binding (Unless otherwise indicated, examples apply to peptides of 9 amino acids; for 10-mers the amino acid at position 5 is disregarded and the resultant 9-mer is evaluated (http://bimas.dcrt.nih.gov/cgi-bin/molbio/hla_coefficient viewing_page. The modifications listed below are provided by way of example based on current data in existing databases and are not intended in any way to be an inclusive list of all potential alterations of peptides binding all potential HLA molecules, both known and unknown to date.) |
|---|
| HLA-B*5101 (8-mer peptides) |
| Any altered peptide that has D, E, F, I, L, M, V, or Y at position 1<br>Any altered peptide that has A, G or P at anchor position 2<br>Any altered peptide that has F, W or Y at position 3<br>Any altered peptide that has D, E, G, I, K, or V at position 4<br>Any altered peptide that has A, G, I, S, T, or V at position 5<br>Any altered peptide that has I, K, L, N, or Q at position 6<br>Any altered peptide that has D, K, Q, or R at position 7<br>Any altered peptide that has I, L, M, or V at anchor position 8<br>Any altered peptide where deleterious residues at the following positions are replaced:<br>P1: K, P, R<br>P2: D, E, H, K<br>P8: D, E, F, G, H, K, N, P, Q, R, S, W, Y |
| HLA-B*5102 |
| Any altered peptide that has F or Y at position 1<br>Any altered peptide that has A, G, or P at anchor position 2<br>Any altered peptide that has F, I, L, V, W, or Y at position 3<br>Any altered peptide that has E, G, H, K, L, N, Q, R, or T at position 4<br>Any altered peptide that has G, N, Q, T, or V at position 5<br>Any altered peptide that has I, N, Q, or T at position 6<br>Any altered peptide that has E, K, Q, or R at position 7<br>Any altered peptide that has K, R, T, or Y at position 8<br>Any altered peptide that has I, L, M, or V at anchor position 9<br>Any altered peptide where deleterious residues at the following positions are replaced:<br>P1: P<br>P2: D, E, H, K, R<br>P3: D, E, K, R<br>P9: D, E, F, G, H, K, N, P, Q, R, S, W, Y |
| HLA-B*5102 (8-mer peptides) |
| Any altered peptide that has F or Y at position 1<br>Any altered peptide that has A, G, or P at anchor position 2<br>Any altered peptide that has F, I, L, V, W, or Y at position 3<br>Any altered peptide that has E, G, H, K, L, V, W, or Y at position 4<br>Any altered peptide that has G, N, Q, T, V at position 5<br>Any altered peptide that has I, N, or Q at position 6<br>Any altered peptide that has Q, or R at position 7<br>Any altered peptide that has I, L, M, or V at position 8<br>Any altered peptide where deleterious residues at the following positions are replaced:<br>P1: P<br>P2: D, E, H, K, R<br>P3: D, E, K, R<br>P8: D, E, F, G, H, K, N, P, Q, R, S, W, Y |
| HLA-B*5103 |
| Any altered peptide that has D, T, or V at position 1<br>Any altered peptide that has A, G, or P at anchor position 2<br>Any altered peptide that has D, F, L, or Y at position 3<br>Any altered peptide that has E, G, L, N, Q, R, T, or V at position 4<br>Any altered peptide that has A, G, M, N, Q, R, K or V at position 5<br>Any altered peptide that has I, K, or T at position 6<br>Any altered peptide that has M or V at position 7<br>Any altered peptide that has I, L, M, or V at anchor position 9<br>Any altered peptide where deleterious residues at the following positions are replaced:<br>P1: P<br>P2: D, E, H, K, R<br>P9: D, E, F, G, H, K, N, P, Q, R, S, W, Y |
| HLA-B*5201 (8-mer peptides) |
| Any altered peptide that has I, L, M, or V at position 1<br>Any altered peptide that has G, P, or Q at anchor position 2<br>Any altered peptide that has D, F, I, L, P, W, or Y at position 3<br>Any altered peptide that has A, E, I, K, L, P, or V at position 4<br>Any altered peptide that has A, F, G, I, L, M, T or V at position 5<br>Any altered peptide that has K, L, N, S or T at position 6<br>Any altered peptide that has E, K, Q, or Y at position 7<br>Any altered peptide that has F, I, L, M, or V at anchor position 8<br>Any altered peptide where deleterious residues at the following positions are replaced:<br>P1: P<br>P2: H, K, R<br>P3: R<br>P8: D, E, G, H, K, N, P, Q, R, S |
| HLA-B*5801 |
| Any altered peptide that has I, K, or R at position 1<br>Any altered peptide that has A, S, or T at anchor position 2<br>Any altered peptide that has D at position 3<br>Any altered peptide that has E, K, or P at position 4<br>Any altered peptide that has F, I, L, M, or V at position 5<br>Any altered peptide that has F, I, L, or V at position 6<br>Any altered peptide that has L, M, N, or Y at position 7<br>Any altered peptide that has K, N, R, or T at position 8<br>Any altered peptide that has F, W, or Y at anchor position 9<br>Any altered peptide where deleterious residues at the following positions are replaced:<br>P1: D, E, P<br>P2: D, E, F, H, I, K, L, M, N, Q, R, V, W, Y<br>P9: D, E, G, H, K, N, P, Q, R, S |
| HLA-B*60 |
| Any altered peptide that has D or E at anchor position 2<br>Any altered peptide that has A, I, L, M, S, or V at position 3<br>Any altered peptide that has L, I, or V at position 5<br>Any altered peptide that has I, L, M, V, or Y at position 7<br>Any altered peptide that has K, Q, or R at position 8<br>Any altered peptide that has I, L, M, or V at anchor position 9<br>Any altered peptide where deleterious residues at the following positions are replaced:<br>P1: P<br>P2: F, H, I, K, L, M, Q, R, V, W, Y<br>P9: D, E, F, G, H, K, N, P, Q, R, S, W, Y |
| HLA-B*61 |
| Any altered peptide that has G or R at position 1<br>Any altered peptide that has D or E at anchor position 2<br>Any altered peptide that has A, F, I, L, M, T, V, W, or Y at position 3<br>Any altered peptide that has I at position 6<br>Any altered peptide that has Y at position 7<br>Any altered peptide that has A, I, L, M, or V at anchor position 9<br>Any altered peptide where deleterious residues at the following positions are replaced:<br>P1: P<br>P2: F, H, I, K, L, M, Q, R, V, W, Y<br>P9: D, E, F, G, H, K, N, P, Q, R, S, W, Y |
| HLA-B*61 (8-mer peptides) |
| Any altered peptide that has G or R at position 1<br>Any altered peptide that has D or E at anchor position 2<br>Any altered peptide that has A, F, I, L, M, T, V, W, or Y at position 3<br>Any altered peptide that has I at position 6<br>Any altered peptide that has Y at position 7<br>Any altered peptide that has A, I, L, M, or V at anchor position 8<br>Any altered peptide where deleterious residues at the following positions are replaced:<br>P1: P<br>P2: F, H, I, K, L, M, Q, R, V, W, Y<br>P8: D, E, F, G, H, K, N, P, Q, R, S, W, Y |

TABLE 4-continued

| Modifications that Enhance HLA Class I Binding (Unless otherwise indicated, examples apply to peptides of 9 amino acids; for 10-mers the amino acid at position 5 is disregarded and the resultant 9-mer is evaluated (http://bimas.dcrt.nih.gov/cgi-bin/molbio/hla_coefficient viewing_page. The modifications listed below are provided by way of example based on current data in existing databases and are not intended in any way to be an inclusive list of all potential alterations of peptides binding all potential HLA molecules, both known and unknown to date.) |
|---|
| HLA-B*62 |
| Any altered peptide that has I at position 1<br>Any altered peptide that has I, L, Q at anchor position 2<br>Any altered peptide that has G, K, R at position 3<br>Any altered peptide that has D, E, G, or P at position 4<br>Any altered peptide that has F, G, I, L, or V at position 5<br>Any altered peptide that has I, L, T, V at position 6<br>Any altered peptide that has T, V, or Y at position 7<br>Any altered peptide that has F, W, Y at anchor position 9<br>Any altered peptide where deleterious residues at the following positions are replaced:<br>P1: P<br>P2: D, E, F, H, K, N, R, S, W, Y<br>P3: D, E<br>P6: D, E, K, R<br>P9: D, E, G, H, K, N, P, Q, R, S |
| HLA-Cw0301 |
| Any altered peptide that has A or R at anchor position 2<br>Any altered peptide that has F, I, L, M, V, or Y at position 3<br>Any altered peptide that has E, P, or R at position 4<br>Any altered peptide that has N at position 5<br>Any altered peptide that has F, M, or Y at position 6<br>Any altered peptide that has K, M, R, or S at position 7<br>Any altered peptide that has T at position 8<br>Any altered peptide that has F, I, L, M at anchor position 9<br>Any altered peptide where deleterious residues at the following positions are replaced:<br>P1: P<br>P3: D, K, R<br>P6: D, E, K, R<br>P9: D, E, G, H, K, N, P, Q, R, S, |

TABLE 4-continued

| Modifications that Enhance HLA Class I Binding (Unless otherwise indicated, examples apply to peptides of 9 amino acids; for 10-mers the amino acid at position 5 is disregarded and the resultant 9-mer is evaluated (http://bimas.dcrt.nih.gov/cgi-bin/molbio/hla_coefficient viewing_page. The modifications listed below are provided by way of example based on current data in existing databases and are not intended in any way to be an inclusive list of all potential alterations of peptides binding all potential HLA molecules, both known and unknown to date.) |
|---|
| HLA-Cw0401 |
| Any altered peptide that has F, P, W, or Y at anchor position 2<br>Any altered peptide that has D, or H at position 3<br>Any altered peptide that has D or E at position 4<br>Any altered peptide that has A, H, M, R, or T at position 5<br>Any altered peptide that has I, L, M, or V at position 6<br>Any altered peptide that has A at position 7<br>Any altered peptide that has H, K, or S at position 8<br>Any altered peptide that has F, I, L, M, V or Y at anchor position 9<br>Any altered peptide where deleterious residues at the following positions are replaced:<br>P1: P<br>P2: D, E, H, K, R<br>P9: D, E, G, H, K, N, P, Q, R, S |
| HLA-Cw0602 |
| Any altered peptide that has F, I, K, or Y at position 1<br>Any altered peptide that has A, P, Q, or R at anchor position 2<br>Any altered peptide that has F, I, K, L, or M at position 5<br>Any altered peptide that has I, L, or V at position 6<br>Any altered peptide that has K, N, Q, or R at position 7<br>Any altered peptide that has I, L, M, V, or Y at anchor position 9<br>Any altered peptide where deleterious residues at the following positions are replaced:<br>P1: P<br>P9: D, E, G, H, K, N, P, Q, R, S |

Examples of predicted human Class I MHC binding peptides from the C35 aa sequence and how they might be changed to improve binding (SEQ ID NO: is shown in parentheses unless peptide is a subsequence of SEQ ID NO:2):

| SEQ ID NO: 2 | | | |
|---|---|---|---|
| Rank | Start position | Subsequence | Score (estimated half time of dissociation) |
| HLA-A*0101 | | | |
| 1 | 77 | KLENGGRPY | 225.000 |
| 2 | 16 | EVEPGSGVR | 90.000 |
| 3 | 29 | YCEPCGFEA | 45.000 |
| 4 | 39 | YLELASAVK | 36.000 |
| 5 | 2 | SGEPGQTSV | 2.250<br>G is deleterious at P2 |
| example of improved peptide | | STEPGQTSV (2059) | 22.50<br>G replaced with T @ P2 |
| example of improved peptide | | STEPGQISY (2060) | 5625.00<br>V at P9 replaced with Y, P7 enhanced |
| HLA-A*0101 (10-mer peptides) | | | |
| 1 | 66 | EIEINGQLVF | 45.000 |
| 2 | 16 | EVEPGSGVRI | 18.000 |
| 3 | 29 | YCEPCGFEAT | 9.000 |

-continued

| SEQ ID NO: 2 | | | |
|---|---|---|---|
| Rank | Start position | Subsequence | Score (estimated half time of dissociation) |
| 4 | 26 | VVEYCEPCGF | 9.000 |
| 5 | 52 | GIEIESRLGG | 2.250 |
| example of improved peptide | | **GTEP**SRLG**Y** (206 1) | 1125.000<br>replace I with T @P2<br>replace G with Y @P9<br>P5 enhanced with P |
| HLA-A*0201 (9-mer peptides) | | | |
| 1 | 9 | SVAPPPEEV | 2.982 |
| 2 | 104 | KITNSRPPC | 2.391 |
| 3 | 105 | ITNSRPPCV | 1.642 |
| 4 | 25 | IVVEYCEPC | 1.485 |
| 5 | 65 | FEIEINGQL | 1.018 |
| example of improved peptide | | **FL**IEIN**WY**L (2062) | 16619.000 |
| HLA-A*0201 (10-mer peptides) | | | |
| 1 | 58 | RLGGTGAFEI | 60.510 |
| 2 | 104 | KITNSRPPCV | 33.472 |
| 3 | 65 | FEIEINGQLV | 25.506 |
| 4 | 83 | F*P*YEKDLIEA | 4.502<br>P is deleterious at P2 |
| example of improved peptide | | F**L**YEKDLIEA (2063) | 689.606<br>replace P with L @ P2 |
| example of improved peptide | | F**L**YEKDLIE**V** (2064) | 9654.485<br>replace A with V @ P9 |
| 5 | 33 | CGFEATYLEL | 3.173 |
| HLA-A*0205 | | | |
| 1 | 65 | FEIEINGQL | 8.820 |
| 2 | 25 | IVVEYCEPC | 3.060 |
| 3 | 9 | SVAPPPEEV | 2.000 |
| 4 | 104 | KITNSRPPC | 1.500 |
| 5 | 81 | G*G*FPYEKDL | 1.260<br>G is deleterious at P2 |
| example of improved peptide | | G**V**FPYEKDL (2065) | 50.400<br>replace G with V @ P2 |
| HLA-A*0205 (10-mer peptides) | | | |
| 1 | 33 | C*G*EFATYLEL | 6.300<br>G is deleterious at P2 |
| example of improved peptide | | C**V**EFATYLEL (2066) | 11.200<br>replace G with V @ P2 |
| 2 | 104 | KITNSRPPCV | 6.000 |
| 3 | 65 | FEIEINGQLV | 2.520 |
| 4 | 53 | IEIESRLGGT | 1.428 |

-continued

| SEQ ID NO: 2 | | | |
|---|---|---|---|
| Rank | Start position | Subsequence | Score (estimated half time of dissociation) |
| 5 | 83 | FPYEKDLIEA | 1.350<br>P is deleterious at P2 |
| example of improved peptide | | FVYEKDLIEA (2067) | 54.000<br>replace P with V @ P2 |
| HLA-A24 | | | |
| 1 | 34 | GFEATYLEL | 33.000 |
| 2 | 49 | QYPGIEIES | 11.550 |
| example of improved peptide | | QYPGIEIEL (2068) | 462.000<br>enhance P9 |
| 3 | 70 | NGQLZFSKL | 11.088 |
| 4 | 38 | TYLELASAV | 10.800 |
| 5 | 82 | GFPYEKDLI | 7.500 |
| HLA-A24 (10-mer peptides) | | | |
| 1 | 64 | AFEIEINGQL | 42.000 |
| 2 | 74 | VFSKLENGGF | 10.000 |
| 3 | 84 | PYEKDLIEAI | 9.000 |
| 4 | 69 | INGQLVFSKL | 7.392 |
| example of improved peptide | | IYGQLVFSKL (2069) | 369.6<br>enhance P2 |
| 5 | 28 | EYCEPCGFEA | 6.600 |
| HLA-A3 | | | |
| 1 | 77 | KLENGGFPY | 36.000 |
| example of improved peptide | | KLENGGFPK (2070) | 180.000<br>enhance P9 |
| 2 | 39 | YLELASAVK | 20.000 |
| 3 | 101 | TLEKITNSR | 6.000 |
| 4 | 61 | GTGAFEIEI | 0.540 |
| 5 | 69 | INGQLVFSK | 0.360<br>N is deleterious @ P2 |
| example of improved peptide | | ILGQLVFSK (2071) | 180.000<br>replace N with L @ P2 |
| HLA-A3 (10-mer peptides) | | | |
| 1 | 68 | EINGQLVFSK | 8.100 |
| 2 | 58 | RLGGTGAFEI | 2.700 |
| 3 | 41 | ELASAVKEQY | 1.800 |
| 4 | 78 | LENGGFPYEK | 0.810<br>E is deleterious @ P2 |
| example of improved peptide | | LLNGGFPYEK (2072) | 270.000<br>replace E with L @ P2 |
| 5 | 95 | RASNGETLEK | 0.400 |

-continued

SEQ ID NO: 2

| Rank | Start position | Subsequence | Score (estimated half time of dissociation) |
|---|---|---|---|
| HLA-A*1101 | | | |
| 1 | 39 | YLELASAVK | 0.400 |
| 2 | 69 | INGQLVFSK | 0.120<br>N is deleterious @ P2 |
| example of improved peptide | | IVGQLVFSK (2073) | 6.000<br>replace N with V @ P2 |
| 3 | 16 | EVEPGSGVR | 0.120 |
| 4 | 101 | TLEKITNSR | 0.080 |
| 5 | 61 | GTGAFEIEI | 0.060 |
| HLA-A*1101 (10-mer peptides) | | | |
| 1 | 95 | RASNGETLEK | 1.200 |
| 2 | 38 | TYLELASAVK | 0.600 |
| 3 | 68 | EINGGLVFSK | 0.360 |
| 4 | 78 | LENGGFPYEK | 0.120<br>E is deleterious @ P2 |
| example of improved peptide | | LVNGGFPYEK (2074) | 4.000<br>replace E with V @ P2 |
| 5 | 100 | ETLEKITNSR | 0.090 |
| HLA-A*3101 | | | |
| 1 | 101 | TLEKITNSR | 2.000 |
| 2 | 16 | EVEPGSGVR | 0.600 |
| 3 | 50 | YPGIEIESR | 0.400 |
| 4 | 87 | KDLIEAIRR | 0.240<br>D is deleterious @ P2 |
| example of improved peptide | | KILIEAIRR (2075) | 12.000<br>replace D with I @ P2 |
| 5 | 39 | YLELASAVK | 0.200 |
| HLA-A*3302 | | | |
| 1 | 16 | EVEPGSGVR | 45.000 |
| 2 | 101 | TLEKITNSR | 9.000 |
| 3 | 50 | YPGIEIESR | 3.000 |
| 4 | 66 | EIEINGQLV | 1.500 |
| 5 | 56 | ESRLGGTGA | 1.500 |
| HLA-A*3302 (10-mer peptides) | | | |
| 1 | 49 | QYPGIEIESR | 15.000 |
| 2 | 100 | ETLEKITNSR | 9.000 |
| 3 | 16 | EVEPGSGVRI | 1.500 |
| 4 | 28 | EYCEPCGFEA | 1.500 |
| 5 | 68 | EINGQLVFSK | 1.500 |

-continued

| Rank | Start position | Subsequence | Score (estimated half time of dissociation) |
|---|---|---|---|
| SEQ ID NO: 2 | | | |
| HLA-A68.1 | | | |
| 1 | 16 | EVEPGSGVR | 900.000 |
| 2 | 9 | SVAPPPEEV | 12.000 |
| 3 | 50 | YPGIEIESR | 10.000 |
| example of improved peptide | | Y**V**GIEIESR (2076) | 400.000 enhance P2 |
| 4 | 96 | ASNGETLEK | 9.000 |
| 5 | 101 | TLEKITNSR | 5.000 |
| HLA-A68.1 (10-mer peptides) | | | |
| 1 | 100 | ETLEKITNSR | 300.000 |
| 2 | 16 | EVEPGSGVRI | 18.000 |
| 3 | 68 | EINGGLVFSK | 9.000 |
| 4 | 15 | E*E*VEPGSGVR | 9.000 E is deleterious @ P2 |
| example of improved peptide | | E**V**VEPGSGR (2077) | 1200.00 replace E with V @ P2 |
| 5 | 95 | RASNGETLEK | 3.000 |
| HLA-B14 | | | |
| 1 | 94 | RRASNGETL | 20.000 |
| 2 | 57 | SRLGGTGAF | 5.000 |
| example of improved peptide | | SRLGGTGA**L** (2078) | 100.000 enhance P9 |
| 3 | 100 | ETLEKITNS | 3.375 |
| 4 | 105 | ITNSRPPCV | 2.000 |
| 5 | 88 | DLIEAIRRA | 1.350 |
| HLA-B14 (10-mer peptides) | | | |
| 1 | 103 | EKITNSRPPC | 6.750 |
| example of improved peptide | | ERITNSRPP**L** (2079) | 900.000 enhance P10 |
| 2 | 33 | CGFEATYLEL | 5.000 |
| 3 | 93 | IRRASNGETL | 4.000 |
| 4 | 18 | EPGSGVRIVV | 3.000 |
| 5 | 88 | DLIEAIRRAS | 2.250 |
| HLA-B40 | | | |
| 1 | 65 | FEIEINGQL | 80.000 |
| 2 | 3 | GEPGQTSVA | 40.000 |
| 3 | 35 | FEATYLELA | 40.000 |
| 4 | 15 | EEVEPGSGV | 24.000 |
| example of improved peptide | | EEVEPGSG**L** (2080) | 120.000 enhance P9 |
| 5 | 67 | IEINGQLVF | 16.000 |

-continued

| SEQ ID NO: 2 | | | |
|---|---|---|---|
| Rank | Start position | Subsequence | Score (estimated half time of dissociation) |
| HLA-B40 (10-mer peptides) | | | |
| 1 | 55 | IESRLGGTGA | 20.000 |
| 2 | 53 | IEIESRLGGT | 16.000 |
| example of improved peptide | | IEIESRLGG**L** (2081) | 80.000 enhance P10 |
| 3 | 65 | FEIEINGQLV | 16.000 |
| 4 | 67 | IEINGQLVFS | 16.000 |
| 5 | 99 | GETLEKITNS | 8.000 |
| HLA-B60 | | | |
| 1 | 65 | FEIEFNGQL | 387.200 |
| 2 | 17 | VEPGSGVRI | 17.600 |
| example of improved peptide | | VEPGSGVR**L** (2082) | 352.000 enhance P9 |
| 3 | 15 | EEVEPGSGV | 16.000 |
| 4 | 47 | KEQYPGIEI | 16.000 |
| 5 | 85 | YEKDLIEAI | 8.800 |
| HLA-B60 (10-mer peptides) | | | |
| 1 | 65 | FEIEINGQLV | 16.000 |
| example of improved peptide | | FEIEINGQL**L** (2083) | 320.000 enhance P10 |
| 2 | 106 | TNSRPPCVIL | 16.000 |
| 3 | 53 | IEIESRLGGT | 8.000 |
| 4 | 33 | CGFEATYLEL | 8.000 |
| 5 | 17 | VEPGSGVRIV | 8.000 |
| HLA-B61 | | | |
| 1 | 15 | EEVEPGSGV | 80.000 |
| 2 | 35 | FEATYLELA | 40.000 |
| example of improved peptide | | FEATYLEL**V** (2084) | 160.000 enhance P9 |
| 3 | 3 | GEPGQTSVA | 22.000 |
| 4 | 65 | FEIEINGQL | 16.000 |
| 5 | 85 | YEKDLIEAI | 16.000 |
| HLA-B61 (10-mer peptides) | | | |
| 1 | 65 | FEIEINGQLV | 80.000 |
| 2 | 17 | VEPGSGVRIV | 40.000 |
| 3 | 55 | IESRLGGTGA | 20.000 |
| 4 | 87 | KDLIEAIRRA | 10.000 |
| example of improved peptide | | K**E**LIEAIRR**V** (2085) | 160.000 enhance P2, P10 |
| 5 | 53 | IEIESRLGGT | 8.000 |

-continued

| SEQ ID NO: 2 | | | |
|---|---|---|---|
| Rank | Start position | Subsequence | Score (estimated half time of dissociation) |
| HLA-B62 | | | |
| 1 | 77 | KLENGGFPY | 24.000 |
| 2 | 21 | SGVRIVVEY | 4.800 |
| 3 | 75 | FSKLENGGF | 3.000 |
| 4 | 31 | E*P*CGFEATY | 2.640<br>P is deleterious @ P2 |
| example of improved peptide | | E**Q**CGFEATY (2086) | 105.6<br>replace P with Q @ P2 |
| 5 | 88 | DLIEAIRRA | 2.200 |
| HLA-B62 (10-mer peptides) | | | |
| 1 | 41 | ELASAVKEQY | 40.000 |
| 2 | 58 | RLGGTGAFEI | 9.600 |
| 3 | 66 | EIEINGQLVF | 7.920 |
| 4 | 56 | E*S*RLGGTGAF | 6.000<br>S is deleterious @ P2 |
| example of improved peptide | | E**Q**RLGGTGAF (2087) | 480.000<br>replace S with Q @ P2 |
| 5 | 20 | G*S*GVRIVVEY | 4.800<br>S is deleterious @ P2 |
| example of improved peptide | | G**Q**GVRIVVEY (2088) | 384.000<br>replace S with Q @P2 |
| HLA-B7 | | | |
| 1 | 107 | NSRPPCVIL | 60.000 |
| example of improved peptide | | N**P**RPPCVIL (2089) | 1200.000<br>enhance P2 |
| 2 | 45 | AVKEQYPGI | 6.000 |
| 3 | 22 | GVRIVVEYC | 5.000 |
| 4 | 70 | NGQLVFSKL | 4.000 |
| 5 | 81 | GGFPYEKDL | 4.000 |
| HLA-B7 (10-mer peptides) | | | |
| 1 | 50 | YPGIEIESRL | 80.000 |
| 2 | 31 | EPCGFEATYL | 80.000 |
| 3 | 18 | EPGSGVRIVV | 6.000 |
| example of improved peptide | | EPGSGVRIV**L** (2090) | 120.000<br>enhance P10 |
| 4 | 106 | TNSRPPCVIL | 6.000 |
| 5 | 80 | NGGFPYEKDL | 4.000 |
| HLA-B8 | | | |
| 1 | 107 | NSRPPCVIL | 4.000 |
| 2 | 45 | AVKEQYPGI | 1.500 |
| 3 | 105 | ITNSRPPCV | 0.600 |
| 4 | 56 | ESRLGGTGA | 0.400 |

-continued

| Rank | Start position | Subsequence | Score (estimated half time of dissociation) |
|---|---|---|---|
| SEQ ID NO: 2 | | | |
| 5 | 100 | ETLEKITN*S* | 0.300<br>S is deleterious @ P9 |
| example of improved peptide | | ETLEKITNL (2091) | 12.000<br>replace S with L @ P9 |
| HLA-B8 (8-mer peptides) | | | |
| 1 | 83 | FPYEKDLI | 6.000 |
| 2 | 107 | NSRPPCVI | 1.000 |
| 3 | 91 | EAIRRAS*N* | 0.800<br>N is deleterious @ P8 |
| example of improved peptide | | EAIRRAS**L** (2092) | 32.000<br>replace N with L @ P9 |
| 4 | 20 | GSGVRIVV | 0.600 |
| 5 | 18 | EPGSGVRI | 0.400 |
| HLA-B8 (10-mer peptides) | | | |
| 1 | 50 | YPGIEIESRL | 0.800 |
| 2 | 93 | IRRASNGETL | 0.400 |
| example of improved peptide | | I**A** RASNGETL (2093) | 16.000<br>replace R with A @ P2 |
| 3 | 31 | EPCGFEATYL | 0.320 |
| 4 | 104 | KITNSRPPCV | 0.300 |
| 5 | 18 | EPGSGVRIVV | 0.240 |
| HLA-B*2702 | | | |
| 1 | 57 | SRLGGTGAF | 200.000 |
| 2 | 94 | RRASNGETL | 180.000 |
| example of improved peptide | | RRASNGET**F** (2094) | 600.000<br>enhance P9 |
| 3 | 93 | IRRASNGET | 20.000 |
| 4 | 27 | VEYCEPCGF | 15.000 |
| 5 | 77 | KLENGGFPY | 9.000 |
| HLA-B*2702 (10-mer peptides) | | | |
| 1 | 93 | IRRASNGETL | 60.000 |
| 2 | 94 | RRASNGETLE | 6.000 |
| 3 | 30 | CEPCGFEATY | 3.000 |
| 4 | 58 | RLGGTGAFEI | 2.700 |
| 5 | 23 | VRIVVEYCE*P* | 2.000<br>P is deleterious @ P10 |
| example of improved peptide | | VRIVVEYCEY (2095) | 200.000<br>replace P with Y @ P10 |
| HLA-B*2705 | | | |
| 1 | 94 | RRASNGETL | 6000.000 |
| 2 | 57 | SRLGGTGAF | 1000.000 |

-continued

| SEQ ID NO: 2 | | | |
|---|---|---|---|
| Rank | Start position | Subsequence | Score (estimated half time of dissociation) |
| 3 | 93 | IRRASNGET | 200.000 |
| example of improved peptide | | IRRASNGE**L** (2096) | 2000.000 enhance P9 |
| 4 | 27 | VEYCEPCGF | 75.000 |
| 5 | 77 | KLENGGFPY | 45.000 |
| HLA-B*2705 (10-mer peptides) | | | |
| 1 | 93 | IRRASNGETL | 2000.000 |
| 2 | 94 | RRASNGETL*E* | 60.000 E is deleterious @ P2 |
| example of improved peptide | | RRASNGETL**L** (2097) | 6000.000 replace E with L @ P2 |
| 3 | 78 | LENGGFPYEK | 30.000 |
| 4 | 95 | RASNGETLEK | 30.000 |
| 5 | 58 | RLGGTGAFEI | 27.000 |
| HLA-B*3501 | | | |
| 1 | 31 | EPCGFEATY | 40.000 |
| 2 | 75 | FSKLENGGF | 22.500 |
| example of improved peptide | | F**P**KLENGG**M** (2098) | 120.000 enhance P2, P9 |
| 3 | 107 | NSRPPCVIL | 15.000 |
| 4 | 42 | LASAVKEQY | 6.000 |
| 5 | 18 | EPGSGVRIV | 4.000 |
| HLA-B*3501 (10-mer peptides) | | | |
| 1 | 31 | EPCGFEATYL | 30.000 |
| 2 | 50 | YPGIEIESRL | 20.000 |
| 3 | 56 | ESRLGGTGAF | 15.000 |
| 4 | 20 | GSGVRIVVEY | 10.000 |
| 5 | 83 | FPYEKDLIEA | 6.000 |
| example of improved peptide | | FPYEKDLIE**M** (2099) | 120.000 enhance P10 |
| HLA-B*3701 | | | |
| 1 | 65 | FEIEINGQL | 15.000 |
| example of improved peptide | | F**D**IEINGQL (2100) | 60.000 enhance P2 |
| 2 | 47 | KEQYPGIEI | 10.000 |
| 3 | 85 | YEKDLIEAI | 10.000 |
| 4 | 17 | VEPGSGVRI | 10.000 |
| 5 | 35 | FEATYLELA | 5.000 |

-continued

| SEQ ID NO: 2 | | | |
|---|---|---|---|
| Rank | Start position | Subsequence | Score (estimated half time of dissociation) |
| HLA-B*3701 (10-mer peptides) | | | |
| 1 | 65 | FEIEINGQLV | 10.000 |
| example of improved peptide | | F**D**IEINGQL**I** (2101) | 200.000 enhance P2, P10 |
| 2 | 67 | IEINGQLVFS | 5.000 |
| 3 | 81 | GGFPYEKDLI | 5.000 |
| 4 | 87 | KDLIEAIRRA | 4.000 |
| 5 | 30 | CEPCGFEATY | 2.000 |
| HLA-B*3801 | | | |
| 1 | 34 | GFEATYLEL | 6.000 |
| example of improved peptide | | G**H**EATYLEL (2102) | 90.000 enhance P2 |
| 2 | 70 | NGQLVFSKL | 1.560 |
| 3 | 38 | TYLELASAV | 1.040 |
| 4 | 81 | GGFPYEKDL | 1.000 |
| 5 | 97 | SNGETLEKI | 0.720 |
| HLA-B*3801 (10-mer peptides) | | | |
| 1 | 64 | AFEIEINGQL | 7.800 |
| example of improved peptide | | A**H**EIEINGQL (2103) | 117.000 enhance P2 |
| 2 | 31 | EPCGFEATYL | 4.800 |
| 3 | 66 | EIEINGQLVF | 3.000 |
| 4 | 26 | VVEYCEPCGF | 3.000 |
| 5 | 50 | YPGIEIESRL | 2.600 |
| HLA-B*3901 | | | |
| 1 | 94 | RRASNGETL | 15.000 |
| example of improved peptide | | R**H**ASNGETL (2104) | 90.000 enhance P2 |
| 2 | 34 | GFEATYLEL | 9.000 |
| 3 | 38 | TYLELASAV | 4.000 |
| 4 | 66 | EIEINGQLV | 3.000 |
| 5 | 2 | SGEPGQTSV | 3.000 |
| HLA-B*3901 (10-mer peptides) | | | |
| 1 | 33 | CGFEATYLEL | 12.000 |
| example of improved peptide | | C**H**FEATYLEL (2105) | 360.000 enhance P2 |
| 2 | 64 | AFEIEINGQL | 9.000 |
| 3 | 93 | IRRASNGETL | 4.500 |
| 4 | 46 | VKEQYPGIEI | 3.000 |
| 5 | 16 | EVEPGSGVRI | 3.000 |

-continued

| SEQ ID NO: 2 | | | |
|---|---|---|---|
| Rank | Start position | Subsequence | Score (estimated half time of dissociation) |
| HLA-B*3902 | | | |
| 1 | 70 | NGQLVFSKL | 2.400 |
| example of improved peptide | | **PNKQLVFSKL** (2106) | 24.000 enhance P2 |
| 2 | 81 | GGFPYEKDL | 2.400 |
| 3 | 94 | RRASNGETL | 2.000 |
| 4 | 34 | GFEATYLEL | 2.000 |
| 5 | 107 | NSRPPCVIL | 0.600 |
| HLA-B*3902 (10-mer peptides) | | | |
| 1 | 69 | INGQLVFSKL | 2.400 |
| 2 | 64 | AFEIEINGQL | 2.400 |
| 3 | 50 | YPGIEIESRL | 2.400 |
| 4 | 80 | NGGFPYEKDL | 2.400 |
| 5 | 106 | TNSRPPCVIL | 2.000 |
| HLA-B*4403 | | | |
| 1 | 67 | IEINGQLVF | 200.000 |
| example of improved peptide | | IEINGQLV**Y** (2107) | 900.000 enhance P9 |
| 2 | 27 | VEYCEPCGF | 40.000 |
| 3 | 21 | SGVRIVVEY | 36.000 |
| 4 | 65 | FEIEINGQL | 20.000 |
| 5 | 35 | FEATYLELA | 12.000 |
| HLA-B*4403 (10-mer peptides) | | | |
| 1 | 30 | CEPCGFEATY | 120.000 |
| 2 | 53 | IEIESRLGGT | 30.000 |
| example of improved peptide | | IEIESRLGG**Y** (2108) | 900.000 enhance P10 |
| 3 | 67 | IEINGQLVFS | 30.000 |
| 4 | 65 | FEIEINGQLV | 20.000 |
| 5 | 17 | VEPGSGVRIV | 18.000 |
| HLA-B*5101 | | | |
| 1 | 18 | EPGSGVRIV | 484.000 |
| 2 | 59 | LGGTGAFEI | 114.400 |
| example of improved peptide | | L**P**GTGAFEI (2109) | 572.000 enhance P2 |
| 3 | 2 | SGEPGQTSV | 48.400 |
| 4 | 81 | GGFPYEKDL | 44.000 |
| 5 | 70 | NGQLVFSKL | 22.000 |

-continued

| | | SEQ ID NO: 2 | |
|---|---|---|---|
| Rank | Start position | Subsequence | Score (estimated half time of dissociation) |
| | | HLA-B*5101 (10-mer peptides) | |
| 1 | 18 | EPGSGVRIVV | 440.000 |
| 2 | 44 | SAVKEQYPGI | 220.000 |
| example of improved peptide | | SPVKEQYPGI (2110) | 440.000 enhance P2 |
| 3 | 31 | EPCGFEATYL | 220.000 |
| 4 | 81 | GGFPYEKDLI | 176.000 |
| 5 | 50 | YPGIEIESRL | 157.300 |
| | | HLA-B*5102 | |
| 1 | 18 | EPGSGVRIV | 242.000 |
| 2 | 81 | GGFPYEKDL | 110.000 |
| example of improved peptide | | GPFPYEKLDI (2111) | 2200.000 enhance P2, P9 |
| 3 | 59 | LGGTGAFEI | 96.800 |
| 4 | 70 | NGQLVFSKL | 48.400 |
| 5 | 2 | SGEPGQTSV | 24.200 |
| | | HLA-B*5102 (10-mer peptide) | |
| 1 | 44 | SAVKEQYPGI | 726.000 |
| example of improved peptide | | SPVKEQYPGI (2112) | 1452.000 enhance P2 |
| 2 | 50 | YPGIEIESRL | 400.000 |
| 3 | 81 | GGFPYEKDLI | 400.000 |
| 4 | 18 | EPGSGVRIVV | 220.000 |
| 5 | 31 | EPCGFEATYL | 121.000 |
| | | HLA-B*5103 | |
| 1 | 59 | LGGTGAFEI | 48.400 |
| example of improved peptide | | LAFTGAFEI (2113) | 145.200 enhance P2 |
| 2 | 2 | SGEPGQTSV | 44.000 |
| 3 | 18 | EPGSGVRIV | 44.000 |
| 4 | 70 | NGQLVFSKL | 7.260 |
| 5 | 81 | GGFPYEKDL | 7.200 |
| | | HLA-B*5103 (10-mer peptide) | |
| 1 | 44 | SAVKEQYPGI | 110.000 |
| 2 | 81 | GGFPYEKDLI | 52.800 |
| 3 | 18 | EPGSGVRIVV | 44.000 |
| example of improved peptide | | EAGSGVRIVV (2114) | 110.000 enhance P2 |
| 4 | 60 | GGTGAFEIEI | 44.000 |
| 5 | 33 | CGFEATYLEL | 7.920 |

-continued

| SEQ ID NO: 2 | | | |
|---|---|---|---|
| Rank | Start position | Subsequence | Score (estimated half time of dissociation) |
| HLA-B*5201 | | | |
| 1 | 18 | WPGSGVRIV | 75.000 |
| 2 | 67 | LEINGQLVF | 22.500 |
| example of improved peptide | | L**Q**INGQLV**I** (2115) | 450.000 enhance P2, P9 |
| 3 | 59 | LGGTGAFEI | 11.250 |
| 4 | 98 | NGETLEKIT | 11.000 |
| 5 | 19 | PGSGVRIVV | 10.000 |
| HLA-B*5201 (10-mer peptides) | | | |
| 1 | 18 | EPGSGVRIVV | 100.000 |
| 2 | 17 | VEPGSGVRIV | 45.000 |
| example of improved peptide | | V**Q**PGSGVRIV (2116) | 450.000 enhance P2 |
| 3 | 81 | GGFPYEKDLI | 33.000 |
| 4 | 105 | ITNSRPPCVI | 15.000 |
| 5 | 37 | ATYLELASAV | 12.000 |
| HLA-B*5801 | | | |
| 1 | 75 | FSKLENGGF | 40.000 |
| example of improved peptide | | FSKLENGG**W** (2117) | 80.000 enhance P9 |
| 2 | 42 | LASAVKEQY | 4.500 |
| 3 | 107 | NSRPPCVIL | 4.000 |
| 4 | 61 | GTGAFEIEI | 3.000 |
| 5 | 105 | ITNSRPPCV | 3.000 |
| HLA-B*5801 (10-mer peptides) | | | |
| 1 | 56 | ESRLGGTGAF | 12.000 |
| 2 | 20 | GSGVRIVVEY | 10.800 |
| example of improved peptide | | GSGVRIVVE**W** (2118) | 144.000 enhance P10 |
| 3 | 1 | MSGEPGQTSV | 4.000 |
| 4 | 105 | ITNSRPPCVI | 3.000 |
| 5 | 37 | ATYLELASAV | 3.000 |
| HLA-Cw*0301 | | | |
| 1 | 65 | FEIEINGQL | 30.000 |
| 2 | 81 | GGFPYEKDL | 18.000 |
| 3 | 70 | NGQLVFSKL | 12.000 |
| 4 | 57 | SRLGGTGAF | 10.000 |
| 5 | 34 | GFEATYLEL | 10.000 |

-continued

| SEQ ID NO: 2 | | | |
|---|---|---|---|
| Rank | Start position | Subsequence | Score (estimated half time of dissociation) |
| HLA-Cw*0301 (10-mer peptides) | | | |
| 1 | 44 | SAVKEQYPGI | 50.000 |
| example of improved peptide | | SAVKEQYPG**L** (2119) | 100.000 enhance P10 |
| 2 | 33 | CGFEATYLEL | 45.000 |
| 3 | 69 | INGQLVFSKL | 12.000 |
| 4 | 81 | GGFPYEKDLI | 3.750 |
| 5 | 106 | TNSRPPCVIL | 3.000 |
| HLA-Cw*0401 | | | |
| 1 | 34 | GFEATYLEL | 240.000 |
| 2 | 38 | TYLELASAV | 30.000 |
| 3 | 82 | GFPYEKDLI | 25.000 |
| 4 | 18 | EPGSGVRIV | 20.000 |
| 5 | 31 | EPCGFEATY | 12.000 |
| example of improved peptide | | E**F**CGFEAT**L** (2120) | 200.000 enhance P2, P9 |
| HLA-Cw*0401 (10-mer peptides) | | | |
| 1 | 64 | AFEIEINGQL | 200.000 |
| 2 | 74 | VFSKLENGGF | 100.000 |
| example of improved peptide | | VFSKIENGG**L** (2121) | 200.000 enhance P10 |
| 3 | 50 | YPGIEIESRL | 80.000 |
| 4 | 31 | EPCGFEATYL | 80.000 |
| 5 | 18 | EPGSGVRIVV | 10.000 |
| HLA-Cw*0602 | | | |
| 1 | 85 | YEKDLIEAI | 6.600 |
| 2 | 65 | FEIEINGQL | 6.600 |
| 3 | 21 | SGVRIVVEY | 6.000 |
| 4 | 31 | EPCGFEATY | 3.300 |
| 5 | 61 | GTGAGEIEI | 3.000 |
| HLA-Cw*0702 | | | |
| 1 | 31 | EPCGFEATY | 24.000 |
| 2 | 21 | SGVRIVVEY | 19.200 |
| 3 | 42 | LASAVKEQY | 8.800 |
| 4 | 77 | KLENGGFPY | 4.000 |
| 5 | 49 | QYPGIEIES | 2.880 |

-continued

| SEQ ID NO: 2 | | | |
|---|---|---|---|
| Rank | Start position | Subsequence | Score (estimated half time of dissociation) |
| HLA-Cw*0702 (10-mer peptides) | | | |
| 1 | 20 | GSGVRIVVEY | 38.400 |
| 2 | 30 | CEPCGFEATY | 16.000 |
| 3 | 41 | ELASAVKEQY | 16.000 |
| 4 | 50 | YPGIEIESRL | 7.920 |
| 5 | 76 | SKLENGGFPY | 4.000 |

TABLE 5

| Predicted C35 HLA Class I epitopes* | | |
|---|---|---|
| HLA restriction element | Inclusive amino acids | Sequence |
| A*0201 | 9-17 of SEQ ID NO: 2 | SVAPPPEEV |
| A*0201 | 10-17 of SEQ ID NO: 2 | VAPPPEEV |
| A*0201 | 16-23 of SEQ ID NO: 2 | EVEPGSGV |
| A*0201 | 16-25 of SEQ ID NO: 2 | EVEPGSGVRI |
| A*0201 | 36-43 of SEQ ID NO: 2 | EATYLELA |
| A*0201 | 37-45 of SEQ ID NO: 2 | ATYLELASA |
| A*0201 | 37-46 of SEQ ID NO: 2 | ATYLELASAV |
| A*0201 | 39-46 of SEQ ID NO: 2 | YLELASAV |
| A*0201 | 44-53 of SEQ ID NO: 2 | SAVKEQYPGI |
| A*0201 | 45-53 of SEQ ID NO: 2 | AVKEQYPGI |
| A*0201 | 52-59 of SEQ ID NO: 2 | GIEIESRL |
| A*0201 | 54-62 of SEQ ID NO: 2 | EIESRLGGT |
| A*0201 | 58-67 of SEQ ID NO: 2 | RLGGTGAFEI |
| A*0201 | 61-69 of SEQ ID NO: 2 | GTGAFEIEI |
| A*0201 | 66-73 of SEQ ID NO: 2 | EIEINGQL |
| A*0201 | 66-74 of SEQ ID NO: 2 | EIEINGQLV |
| A*0201 | 88-96 of SEQ ID NO: 2 | DLIEAIRRA |
| A*0201 | 89-96 of SEQ ID NO: 2 | LIEAIRRA |
| A*0201 | 92-101 of SEQ ID NO: 2 | AIRRASNGET |
| A*0201 | 95-102 of SEQ ID NO: 2 | RASNGETL |
| A*0201 | 104-113 of SEQ ID NO: 2 | KITNSRPPCV |
| A*0201 | 105-113 of SEQ ID NO: 2 | ITNSRPPCV |
| A*0201 | 105-114 of SEQ ID NO: 2 | ITNSRPPCVI |
| A*3101 | 16-24 of SEQ ID NO: 2 | EVEPGSGVR |

TABLE 5-continued

| Predicted C35 HLA Class I epitopes* | | |
|---|---|---|
| HLA restriction element | Inclusive amino acids | Sequence |
| B*3501 | 30-38 of SEQ ID NO: 2 | EPCGFEATY |
| A*30101 supermotif | 96-104 of SEQ ID NO: 2 | ASNGETLEK |

*predicted using rules found at the SYFPEITHI website (wysiwyg://35/http://134.2.96.221/scripts/hlaserver.dll/EpPredict.htm) and are based on the book "MHC Ligands and Peptide Motifs" by Rammensee, H. G., Bachmann, J. and S. Stevanovic. Chapman & Hall, New York, 1997.

TABLE 6

| Predicted C35 HLA class II epitopes* | | |
|---|---|---|
| Sequence | Inclusive amino acids | Restriction elements |
| SGVRIVVEYCEPCGF (amino acids 21-35 of SEQ ID NO: 2) | 21-35 | DRB1*0101<br>DRB1*0102<br>DRB1*0301<br>DRB1*0401<br>DRB1*0404<br>DRB1*0405<br>DRB1*0410<br>DRB1*0421<br>DRB1*0701<br>DRB1*0801<br>DRB1*0804<br>DRB1*0806<br>DRB1*1101<br>DRB1*1104<br>DRB1*1106<br>DRB1*1107<br>DRB1*1305<br>DRB1*1307<br>DRB1*1321<br>DRB1*1501<br>DRB1*1502<br>DRB5*0101 |
| SRLGGTGAFEIEINGQLVF (amino acids 57-75 of SEQ ID NO: 2) | 57-75 | DRB1*0101<br>DRB1*0102<br>DRB1*0301<br>DRB1*0401<br>DRB1*0402<br>DRB1*0421<br>DRB1*0701<br>DRB1*0804<br>DRB1*0806<br>DRB1*1101<br>DRB1*1104<br>DRB1*1106 |

TABLE 6-continued

| Predicted C35 HLA class II epitopes* | | |
|---|---|---|
| Sequence | Inclusive amino acids | Restriction elements |
| | | DRB1*1305<br>DRB1*1321<br>DRB1*1501<br>DRB1*1502<br>DRB5*0101 |
| GAFEIEINGQLVFSKLENGGF (amino acids 63-83 of SEQ ID NO: 2) | 63-83 | DRB1*0101<br>DRB1*0102<br>DRB1*0301<br>DRB1*0401<br>DRB1*0402<br>DRB1*0404<br>DRB1*0405<br>DRB1*0410<br>DRB1*0421<br>DRB1*0701<br>DRB1*0804<br>DRB1*0806<br>DRB1*1101<br>DRB1*1104<br>DRB1*1106<br>DRB1*1107<br>DRB1*1305<br>DRB1*1307<br>DRB1*1311<br>DRB1*1321<br>DRB1*1501<br>DRB1*1502<br>DRB5*0101 |
| FPYEKDLIEAIRRASNGETLE (amino acids 83-103 of SEQ ID NO: 2) | 83-103 | DRB1*0101<br>DRB1*0102<br>DRB1*0301<br>DRB1*0401<br>DRB1*0402<br>DRB1*0404<br>DRB1*0405<br>DRB1*0410<br>DRB1*0421<br>DRB1*0701<br>DRB1*0801<br>DRB1*0802<br>DRB1*0804<br>DRB1*0806<br>DRB1*1101<br>DRB1*1104<br>DRB1*1106<br>DRB1*1107<br>DRB1*1305<br>DRB1*1307<br>DRB1*1311<br>DRB1*1321<br>DRB1*1501<br>DRB1*1502<br>DRB5*0101 |

*Class II MHC epitopes predicted using TEPITOPE software. Sturniolo, T., et al. 1999. Generation of tissue specific and promiscuous HLA ligand databases using DNA microarrays and virtual HLA class II matrices. Nature Biotechnology 17:555571.

In the present invention, "epitopes" refer to C35 polypeptide fragments having antigenic or immunogenic activity in an animal, especially in a human, or that are capable of eliciting a T lymphocyte response in an animal, preferably a human. A preferred embodiment of the present invention relates to a C35 polypeptide fragment comprising a C35 peptide epitope, as well as the polynucleotide encoding this fragment. A further preferred embodiment of the present invention relates to a C35 polypeptide fragment consisting of an epitope, as well as the polynucleotide encoding this fragment. In specific preferred embodiments of the present invention, the epitope comprises a C35 fragment listed in any of Tables 1-3 or 5-6, exclusive of E-100 to R-109 of SEQ ID NO:2. In another preferred embodiment of the present invention, the epitope consists of a C35 fragment listed in any of Tables 1-3 and 5-6 exclusive of E-100 to R-109 of SEQ ID NO:2. A region of a protein molecule to which an antibody can bind is defined as an "antigenic epitope." In contrast, an "immunogenic epitope" is defined as a part of a protein that elicits T cell response. (See, for instance, Geysen et al., *Proc. Natl. Acad. Sci. USA* 81:3998 4002 (1983)). Thus, a further preferred embodiment of the present invention is an immunogenic C35 peptide fragment that is capable of eliciting a T cell response when bound to the peptide binding cleft of an MHC molecule. In a specific preferred embodiment, the immunogenic C35 peptide fragment comprises an epitope listed in any of Tables 1-3 or 5-6 exclusive of E-100 to R-109 of SEQ ID NO:2. In another preferred embodiment, the immunogenic C35 peptide fragment consists of an epitope listed in any of Tables 1-3 or 5-6 exclusive of E-100 to R-109 of SEQ ID NO:2. Further embodiments of the invention are directed to pharmaceutical formulations and vaccine compositions comprising said immunogenic C35 peptide fragments or the polynucleotides encoding them.

Fragments which function as epitopes may be produced by any conventional means. (See, e.g., Houghten, R. A., *Proc. Natl. Acad. Sci. USA* 82:51315135 (1985) further described in U.S. Pat. No. 4,631,211.)

The sequence of peptide epitopes known to bind to specific MHC molecules can be modified at the known peptide anchor positions in predictable ways that act to increase MHC binding affinity. Such "epitope enhancement" has been employed to improve the immunogenicity of a number of different MHC class I or MHC class II binding peptide epitopes (Berzofsky, J. A. et al., *Immunol. Rev.* 170:151-72 (1999); Ahlers, J. D. et al., *Proc. Natl. Acad. Sci U.S.A.* 94:10856-61 (1997); Overwijk, et al., *J. Exp. Med.* 188:277-86 (1998); Parkhurst, M. R. et al., *J. Immunol.* 157:2539-48 (1996)). Accordingly, a further embodiment of the invention is directed to such enhanced C35 peptide epitope analogs, and to the polynucleotides encoding such analogs.

In the present invention, antigenic epitopes preferably contain a sequence of at least seven, more preferably at least nine, and most preferably between about 15 to about 30 amino acids. Antigenic epitopes are useful to raise antibodies, including monoclonal antibodies, that specifically bind the epitope. (See, for instance, Wilson et al., *Cell* 37:767778 (1984); Sutcliffe, J. G. et al., *Science* 219:660666 (1983).)

Similarly, immunogenic epitopes can be used to induce B cells and T cells according to methods well known in the art. (See Sutcliffe et al., supra; Wilson et al., supra; Chow, M. et al., *Proc. Natl. Acad. Sci. USA* 82:910914; and Bittle, F. J. et al., *J. Gen. Virol.* 66:23472354 (1985).) The immunogenic epitopes may be presented together with a carrier protein, such as an albumin, to an animal system (such as rabbit or mouse) or, if it is long enough (at least about 25 amino acids), without a carrier. However, immunogenic epitopes comprising as few as 9 amino acids have been shown to be sufficient to raise antibodies capable of binding to, at the very least, linear epitopes in a denatured polypeptide (e.g., in Western blotting.)

As used herein, the term "antibody" (Ab) or "monoclonal antibody" (Mab) is meant to include intact molecules as well as antibody fragments (such as, for example, Fab and F(ab')2 fragments) which are capable of specifically binding to protein. Fab and F(ab')2 fragments lack the Fc fragment of intact antibody, clear more rapidly from the circulation, and may have less nonspecific tissue binding than an intact antibody. (Wahl et al., *J. Nucl. Med.* 24:316325 (1983).) Thus, for some applications these fragments are preferred, as well as the products of a Fab or other immunoglobulin expression library. Moreover, antibodies of the present invention include chimeric, single chain, and humanized antibodies.

Diagnostic and Therapeutic Uses of Antibodies

The present invention further relates to C35 antibodies, C35 antibody fragments and antibody conjugates and singlechain immunotoxins reactive with human carcinoma cells, particularly human breast and bladder carcinoma cells.

Table 7 provides a list of C35-specific monoclonal antibodies that have been isolated and characterized for use in different applications.

TABLE 7

C35-Specific Murine Monoclonal Antibodies

| Fusion | Hybridoma | ELISA | Isotype | Western Blot | Flow Cytometry | Immunohisto-chemistry |
|--------|-----------|-------|---------|--------------|----------------|-----------------------|
| alpha  | 1F5       | positive | IgM  |              | positive       | positive              |
|        | 1F7       | positive | IgM  |              | positive       |                       |
|        | 1F11      | positive | IgM  |              | positive       |                       |
|        | 2D9       | positive | IgM  | positive     | positive       | positive              |
| beta   | 2G3       | positive | IgG1 |              |                |                       |
|        | 2G8       | positive |      |              |                |                       |
|        | 2G10      | positive | IgG3 |              |                |                       |
|        | 2G11      | positive | IgG3 |              |                |                       |
|        | 3F9       | positive | IgG1 |              |                |                       |
|        | 4D11      | positive | IgG1 |              |                |                       |
|        | 4G3       | positive | IgG3 |              |                |                       |
|        | 7C2       | positive | IgM  |              |                |                       |
|        | 8B11      | positive | IgM  |              |                |                       |
|        | 8G2       | positive | IgM  |              |                |                       |
|        | 10F4      | positive | IgG1 |              |                |                       |
|        | 11B10     | positive | IgM  | positive     |                |                       |
|        | 12B10     | positive |      |              |                |                       |
|        | 16C10     | positive | IgM  |              |                |                       |
|        | 16F10     | positive |      |              |                |                       |

ELISA assay on bacterially-synthesized C35 blank = not determined

As used in this example, the following words or phrases have the meanings specified.

As used in this example, "joined" means to couple directly or indirectly one molecule with another by whatever means, e.g., by covalent bonding, by noncovalent bonding, by ionic bonding, or by nonionic bonding. Covalent bonding includes bonding by various linkers such as thioether linkers or thioester linkers. Direct coupling involves one molecule attached to the molecule of interest. Indirect coupling involves one molecule attached to another molecule not of interest which in turn is attached directly or indirectly to the molecule of interest.

As used in this example, "recombinant molecule" means a molecule produced by genetic engineering methods.

As used in this example, "fragment" is defined as at least a portion of the variable region of the immunoglobulin molecule which binds to its target, i.e. the antigen binding region. Some of the constant region of the immunoglobulin may be included.

As used in this example, an "immunoconjugate" means any molecule or ligand such as an antibody or growth factor chemically or biologically linked to a cytotoxin, a radioactive agent, an antitumor drug or a therapeutic agent. The antibody or growth factor may be linked to the cytotoxin, radioactive agent, antitumor drug or therapeutic agent at any location along the molecule so long as it is able to bind its target. Examples of immunoconjugates include immunotoxins and antibody conjugates.

As used in this example, "selectively killing" means killing those cells to which the antibody binds.

As used in this example, examples of "carcinomas" include bladder, breast, colon, liver, lung, ovarian, and pancreatic carcinomas.

As used in this example, "immunotoxin" means an antibody or growth factor chemically or biologically linked to a cytotoxin or cytotoxic agent.

As used in this example, an "effective amount" is an amount of the antibody, immunoconjugate, recombinant molecule which kills cells or inhibits the proliferation thereof.

As used in this example, "competitively inhibits" means being capable of binding to the same target as another molecule. With regard to an antibody, competitively inhibits mean that the antibody is capable of recognizing and binding the same antigen binding region to which another antibody is directed.

As used in this example, "antigenbinding region" means that part of the antibody, recombinant molecule, the fusion protein, or the immunoconjugate of the invention which recognizes the target or portions thereof.

As used in this example, "therapeutic agent" means any agent useful for therapy including antitumor drugs, cytotoxins, cytotoxin agents, and radioactive agents.

As used in this example, "antitumor drug" means any agent useful to combat cancer including, but not limited to, cytotoxins and agents such as antimetabolites, alkylating agents, anthracyclines, antibiotics, antimitotic agents, procarbazine, hydroxyurea, asparaginase, corticosteroids, mytotane (O,P' (DDD)), interferons and radioactive agents.

As used in this example, "a cytotoxin or cytotoxic agent" means any agent that is detrimental to cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1dehydrotestosterone, glucocorticoids, procaine, tetracaine, lidocaine, propranolol, and puromycin and analogs or homologs thereof.

As used in this example, "radioisotope" includes any radioisotope which is effective in destroying a tumor. Examples include, but are not limited to, cobalt60 and Xrays. Additionally, naturally occurring radioactive elements such as uranium, radium, and thorium which typically represent mixtures of radioisotopes, are suitable examples of a radioactive agent.

As used in this example, "administering" means oral administration, administration as a suppository, topical contact, intravenous, intraperitoneal, intramuscular or subcutaneous administration, or the implantation of a slowrelease device such as a miniosmotic pump, to the subject.

As used in this example, "directly" means the use of antibodies coupled to a label. The specimen is incubated with the labeled antibody, unbound antibody is removed by washing, and the specimen may be examined.

As used in this example, "indirectly" means incubating the specimen with an unconjugated antibody, washing and incubating with a fluorochromeconjugated antibody. The second or "sandwich" antibody thus reveals the presence of the first.

As used in this example "reacting" means to recognize and bind the target. The binding may be nonspecific. Specific binding is preferred.

As used in this example, "curing" means to provide substantially complete tumor regression so that the tumor is not palpable for a period of time, i.e., >/=10 tumor volume doubling delays (TVDD=the time in days that it takes for control tumors to double in size).

As used in this example, "tumor targeted antibody" means any antibody which recognizes the C35 antigen on tumor (i.e., cancer) cells.

As used in this example, "inhibit proliferation" means to interfere with cell growth by whatever means.

As used in this example, "mammalian tumor cells" include cells from animals such as human, ovine, porcine, murine, bovine animals.

As used in this example, "pharmaceutically acceptable carrier" includes any material which when combined with the antibody retains the antibody's immunogenicity and is nonreactive with the subject's immune systems. Examples include, but are not limited to, any of the standard pharmaceutical carriers such as a phosphate buffered saline solution, water, emulsions such as oil/water emulsion, and various types of wetting agents. Other carriers may also include sterile solutions, tablets including coated tablets and capsules.

Typically such carriers contain excipients such as starch, milk, sugar, certain types of clay, gelatin, stearic acid or salts thereof, magnesium or calcium stearate, talc, vegetable fats or oils, gums, glycols, or other known excipients. Such carriers may also include flavor and color additives or other ingredients. Compositions comprising such carriers are formulated by well known conventional methods.

The present invention relates to C35 antibodies that are highly specific for carcinoma cells. More particularly, the antibodies react with a range of carcinomas such as breast, bladder, lung, ovary and colon carcinomas, while showing none or limited reactivity with normal human tissues or other types of tumors such as, for example, sarcomas or lymphomas.

The term "C35 antibody" as used herein includes whole, intact polyclonal and monoclonal antibody materials, and chimeric antibody molecules. The C35 antibody described above includes any fragments thereof containing the active antigenbinding region of the antibody such as Fab, F(ab')2 and Fv fragments, using techniques well established in the art [see, e.g., Rousseaux et al., "Optimal Conditions For The Preparation of Proteolytic Fragments From Monoclonal IgG of Different Rat IgG Subclasses", in *Methods Enzymol.,* 121: 66369 (Academic Press 1986)]. The C35 antibody of the invention also includes fusion proteins.

Also included within the scope of the invention are antiidiotypic antibodies to the C35 antibody of the invention. These antiidiotypic antibodies can be produced using the C35 antibody and/or the fragments thereof as immunogen and are useful for diagnostic purposes in detecting humoral response to tumors and in therapeutic applications, e.g., in a vaccine, to induce an antitumor response in patients [see, e.g., Nepom et al., "AntiIdiotypic Antibodies And The Induction Of Specific Tumor Immunity", in *Cancer And Metastasis Reviews,* 6:487501 (1987)].

In addition, the present invention encompasses antibodies that are capable of binding to the same antigenic determinant as the C35 antibodies and competing with the antibodies for binding at that site. These include antibodies having the same antigenic specificity as the C35 antibodies but differing in species origin, isotype, binding affinity or biological functions (e.g., cytotoxicity). For example, class, isotype and other variants of the antibodies of the invention having the antigenbinding region of the C35 antibody can be constructed using recombinant classswitching and fusion techniques known in the art [see, e.g., Thammana et al., "Immunoglobulin Heavy Chain Class Switch From IgM to IgG In A Hybridoma", *Eur. J. Immunol.,* 13:614 (1983); Spira et al., "The Identification of Monoclonal Class Switch Variants by Subselection and ELISA Assay", *J. Immunol. Meth.* 74:30715 (1984); Neuberger et al., "Recombinant Antibodies Possessing Novel Effector Functions", *Nature* 312: 614608 (1984); and Oi et al., "Chimeric Antibodies", *Biotechniques* 4 (3): 21421 (1986)]. Thus, other chimeric antibodies or other recombinant antibodies (e.g., fusion proteins wherein the antibody is combined with a second protein such as a lymphokine or a tumor inhibitory growth factor) having the same binding specificity as the C35-specific antibodies fall within the scope of this invention.

Genetic engineering techniques known in the art may be used as described herein to prepare recombinant immunotoxins produced by fusing antigen binding regions of antibody C35 to a therapeutic or cytotoxic agent at the DNA level and producing the cytotoxic molecule as a chimeric protein. Examples of therapeutic agents include, but are not limited to, antimetabolites, alkylating agents, anthracyclines, antibiotics, and antimitotic agents. Antimetabolites include methotrexate, 6mercaptopurine, 6thioguanine, cytarabine, 5-fluorouracil decarbazine. Alkylating agents include mechlorethamine, thioepa chlorambucil, melphalan, carmustine (BSNU) and lomustine (CCNU), cyclothosphamide, busulfan, dibromomannitol, streptozotocin, mitomycin C, and cisdichlorodiamine platinum (II) (DDP) cisplatin. Anthracyclines include daunorubicin (formerly daunomycin) and doxorubicin (also referred to herein as adriamycin). Additional examples include mitozantrone and bisantrene. Antibiotics include dactinomycin (formerly actinomycin), bleomycin, mithramycin, and anthramycin (AMC). Antimytotic agents include vincristine and vinblastine (which are commonly referred to as vinca alkaloids). Other cytotoxic agents include procarbazine, hydroxyurea, asparaginase, corticosteroids, mytotane (O,P'(DDD)), interferons. Further examples of cytotoxic agents include, but are not limited to, ricin, doxorubicin, taxol, cytochalasin B, gramicidin D, ethidium bromide, etoposide, tenoposide, colchicin, dihydroxy anthracin dione, 1dehydrotestosterone, and glucocorticoid.

Clearly analogs and homologs of such therapeutic and cytotoxic agents are encompassed by the present invention. For example, the chemotherapuetic agent aminopterin has a correlative improved analog namely methotrexate. Further, the improved analog of doxorubicin is an Fechelate. Also, the improved analog for 1methylnitrosourea is lomustine. Further, the improved analog of vinblastine is vincristine. Also, the improved analog of mechlorethamine is cyclophosphamide.

Recombinant immunotoxins, particularly singlechain immunotoxins, have an advantage over drug/antibody conjugates in that they are more readily produced than these conjugates, and generate a population of homogenous molecules, i.e. single peptides composed of the same amino acid residues. The techniques for cloning and expressing DNA sequences encoding the amino acid sequences corresponding to C35 singlechain immunotoxins, e.g synthesis of oligonucleotides, PCR, transforming cells, constructing vectors, expression systems, and the like are well established in the art, and most practitioners are familiar with the standard resource materials for specific conditions and procedures [see, e.g., Sambrook et al., eds., *Molecular Cloning, A Laboratory Manual,* 2nd Edition, Cold Spring Harbor Laboratory Press (1989)].

The following include preferred embodiments of the immunoconjugates of the invention. Other embodiments which are known in the art are encompassed by the invention. The invention is not limited to these specific immunoconjugates, but also includes other immunoconjugates incorporating antibodies and/or antibody fragments according to the present invention.

The conjugates comprise at least one drug molecule connected by a linker of the invention to a targeting ligand molecule that is reactive with the desired target cell population. The ligand molecule can be an immunoreactive protein such as an antibody, or fragment thereof, a nonimmunoreactive protein or peptide ligand such as bombesin or, a binding ligand recognizing a cell associated receptor such as a lectin or steroid molecule.

Further, because the conjugates of the invention can be used for modifying a given biological response, the drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin; a protein such as tumor necrosis factor, alpha interferon, beta interferon, nerve growth factor, platelet derived growth factor, tissue plasminogen activator; or, biological response modifiers such as, for example, lymphokines, interleukin1 ("IL1"), interleukin2 ("IL2"), interleukin6 ("IL6"), granulocyte macrophase colony stimulating factor ("GMCSF"), granulocyte colony stimulating factor ("GCSF"), or other growth factors.

The preferred drugs for use in the present invention are cytotoxic drugs, particularly those which are used for cancer therapy. Such drugs include, in general, alkylating agents, antiproliferative agents, tubulin binding agents and the like. Preferred classes of cytotoxic agents include, for example, the anthracycline family of drugs, the vinca drugs, the mitomycins, the bleomycins, the cytotoxic nucleosides, the pteridine family of drugs, diynenes, and the podophyllotoxins. Particularly useful members of those classes include, for example, adriamycin, caminomycin, daunorubicin, aminopterin, methotrexate, methopterin, dichloromethotrexate, mitomycin C, porfiromycin, 5fluorouracil, 6mercaptopurine, cytosine arabinoside, podophyllotoxin, or podophyllotoxin derivatives such as etoposide or etoposide phosphate, melphalan, vinblastine, vincristine, leurosidine, vindesine, leurosine and the like. As noted previously, one skilled in the art may make chemical modifications to the desired compound in order to make reactions of that compound more convenient for purposes of preparing conjugates of the invention.

As noted, one skilled in the art will appreciate that the invention also encompasses the use of antigen recognizing immunoglobulin fragments. Such immunoglobulin fragments may include, for example, the Fab', F(ab')2, F[v] or Fab fragments, or other antigen recognizing immunoglobulin fragments. Such immunoglobulin fragments can be prepared, for example, by proteolytic enzyme digestion, for example, by pepsin or papain digestion, reductive alkylation, or recombinant techniques. The materials and methods for preparing such immunoglobulin fragments are wellknown to those skilled in the art. See generally, Parham, *J. Immunology* 131: 2895 (1983); Lamoyi et al., *J. Immunological Methods* 56:235 (1983); Parham, id., 53, 133 (1982); and Matthew et al., id., 50, 239 (1982).

The immunoglobulin can be a "chimeric antibody" as that term is recognized in the art. Also, the immunoglobulin may be a "bifunctional" or "hybrid" antibody, that is, an antibody which may have one arm having a specificity for one antigenic site, such as a tumor associated antigen while the other arm recognizes a different target, for example, a hapten which is, or to which is bound, an agent lethal to the antigenbearing tumor cell. Alternatively, the bifunctional antibody may be one in which each arm has specificity for a different epitope of a tumor associated antigen of the cell to be therapeutically or biologically modified. In any case, the hybrid antibodies have a dual specificity, preferably with one or more binding sites specific for the hapten of choice or one or more binding sites specific for a target antigen, for example, an antigen associated with a tumor, an infectious organism, or other disease state.

Biological bifunctional antibodies are described, for example, in European Patent Publication, EPA 0 105 360, to which those skilled in the art are referred. Such hybrid or bifunctional antibodies may be derived, as noted, either biologically, by cell fusion techniques, or chemically, especially with crosslinking agents or disulfide bridgeforming reagents, and may be comprised of whose antibodies and/or fragments thereof. Methods for obtaining such hybrid antibodies are disclosed, for example, in PCT application WO83/03679, published Oct. 27, 1983, and published European Application EPA 0 217 577, published Apr. 8, 1987. Particularly preferred bifunctional antibodies are those biologically prepared from a "polydome" or "quadroma" or which are synthetically prepared with crosslinking agents such as bis(maleimideo)methyl ether ("BMME"), or with other crosslinking agents familiar to those skilled in the art.

In addition the immunoglobulin may be a single chain antibody ("SCA"). These may consist of single chain Fv fragments ("scFv") in which the variable light ("V[L]") and variable heavy ("V[H]") domains are linked by a peptide bridge or by disulfide bonds. Also, the immunoglobulin may consist of single V[H] domains (dAbs) which possess antigenbinding activity. See, e.g., G. Winter and C. Milstein, *Nature* 349:295 (1991); R. Glockshuber et al., *Biochemistry* 29:1362 (1990); and, E. S. Ward et al., *Nature* 341: 544 (1989).

Especially preferred for use in the present invention are chimeric monoclonal antibodies, preferably those chimeric antibodies having specificity toward a tumor associated antigen. As used in this example, the term "chimeric antibody" refers to a monoclonal antibody comprising a variable region, i.e. binding region, from one source or species and at least a portion of a constant region derived from a different source or species, usually prepared by recombinant DNA techniques. Chimeric antibodies comprising a murine variable region and a human constant region are preferred in certain applications of the invention, particularly human therapy, because such antibodies are readily prepared and may be less immunogenic than purely murine monoclonal antibodies. Such murine/human chimeric antibodies are the product of expressed immunoglobulin genes comprising DNA segments encoding murine immunoglobulin variable regions and DNA segments encoding human immunoglobulin constant regions. Other forms of chimeric antibodies encompassed by the invention are those in which the class or subclass has been modified or changed from that of the original antibody. Such "chimeric" antibodies are also referred to as "classswitched antibodies". Methods for producing chimeric antibodies involve conventional recombinant DNA and gene transfection techniques now well known in the art. See, e.g., Morrison, S. L. et al., *Proc. Nat'l Acad. Sci.* 81:6851 (1984).

Encompassed by the term "chimeric antibody" is the concept of "humanized antibody", that is those antibodies in which the framework or "complementarity" determining regions ("CDR") have been modified to comprise the CDR of an immunoglobulin of different specificity as compared to that of the parent immunoglobulin. In a preferred embodiment, a murine CDR is grafted into the framework region of a human antibody to prepare the "humanized antibody". See, e.g., L. Riechmann et al., *Nature* 332:323 (1988); M. S. Neuberger et al., *Nature* 314:268 (1985). Particularly preferred CDR'S correspond to those representing sequences recognizing the antigens noted above for the chimeric and bifunctional antibodies. The reader is referred to the teaching of EPA 0 239 400 (published Sep. 30, 1987), for its teaching of CDR modified antibodies.

One skilled in the art will recognize that a bifunctionalchimeric antibody can be prepared which would have the benefits of lower immunogenicity of the chimeric or humanized antibody, as well as the flexibility, especially for therapeutic treatment, of the bifunctional antibodies described above. Such bifunctionalchimeric antibodies can be synthesized, for instance, by chemical synthesis using crosslinking agents and/or recombinant methods of the type described above. In any event, the present invention should not be construed as limited in scope by any particular method of production of an antibody whether bifunctional, chimeric, bifunctionalchimeric, humanized, or an antigen-recognizing fragment or derivative thereof.

In addition, the invention encompasses within its scope immunoglobulins (as defined above) or immunoglobulin fragments to which are fused active proteins, for example, an enzyme of the type disclosed in Neuberger, et al., PCT application, WO86/01533, published Mar. 13, 1986. The disclosure of such products is incorporated herein by reference.

As noted, "bifunctional", "fused", "chimeric" (including humanized), and "bifunctionalchimeric" (including humanized) antibody constructions also include, within their individual contexts constructions comprising antigen recognizing fragments. As one skilled in the art will recognize, such fragments could be prepared by traditional enzymatic cleavage of intact bifunctional, chimeric, humanized, or chimericbifunctional antibodies. If, however, intact antibodies are not susceptible to such cleavage, because of the nature of the construction involved, the noted constructions can be prepared with immunoglobulin fragments used as the starting materials; or, if recombinant techniques are used, the DNA sequences, themselves, can be tailored to encode the desired "fragment" which, when expressed, can be combined in vivo or in vitro, by chemical or biological means, to prepare the final desired intact immunoglobulin "fragment". It is in this context, therefore, that the term "fragment" is used.

Furthermore, as noted above, the immunoglobulin (antibody), or fragment thereof, used in the present invention may be polyclonal or monoclonal in nature. Monoclonal antibodies are the preferred immunoglobulins, however. The preparation of such polyclonal or monoclonal antibodies now is well known to those skilled in the art who, of course, are fully capable of producing useful immunoglobulins which can be used in the invention. See, e.g., G. Kohler and C. Milstein, *Nature* 256: 495 (1975). In addition, hybridomes and/or monoclonal antibodies which are produced by such hybridomas and which are useful in the practice of the present invention are publicly available from sources such as the American Type Culture Collection ("ATCC") 10801 University Blvd., Manassas, Va. 20110.

Particularly preferred monoclonal antibodies for use in the present invention are those which recognize tumor associated antigens.

Diagnostic Techniques

Serologic diagnostic techniques involve the detection and quantitiation of tumorassociated antigens that have been secreted or "shed" into the serum or other biological fluids of patients thought to be suffering from carcinoma. Such antigens can be detected in the body fluids using techniques known in the art such as radioimmunoassays (RIA) or enzymelinked immunosorbent assays (ELISA) wherein an antibody reactive with the "shed" antigen is used to detect the presence of the antigen in a fluid sample [see, e.g., Uotila et al., "TwoSite Sandwich ELISA With Monoclonal Antibodies To Human AFP", *J. Immunol. Methods* 42:11 (1981) and Allum et al., supra at pp. 4851]. These assays, using the C35 antibodies disclosed herein, can therefore be used for the detection in biological fluids of the antigen with which the C35 antibodies react and thus the detection of human carcinoma in patients. Thus, it is apparent from the foregoing that the C35 antibodies of the invention can be used in most assays involving antigenantibody reactions. These assays include, but are not limited to, standard RIA techniques, both liquid and solid phase, as well as ELISA assays, ELISPOT, immunofluorescence techniques, and other immunocytochemical assays [see, e.g., Sikora et al. (eds.), *Monoclonal Antibodies, pp.* 3252 (Blackwell Scientific Publications 1984)].

The invention also encompasses diagnostic kits for carrying out the assays described above. In one embodiment, the diagnostic kit comprises the C35 monoclonal antibody, fragments thereof, fusion proteins or chimeric antibody of the invention, and a conjugate comprising a specific binding partner for the C35 antibody and a label capable of producing a detectable signal. The reagents can also include ancillary agents such as buffering agents and protein stabilizing agents (e.g., polysaccharides). The diagnostic kit can further comprise, where necessary, other components of the signalproducing system including agents for reducing background interference, control reagents or an apparatus or container for conducting the test.

In another embodiment, the diagnostic kit comprises a conjugate of the C35 antibodies of the invention and a label capable of producing a detectable single. Ancillary agents as mentioned above can also be present.

The C35 antibody of the invention is also useful for in vivo diagnostic applications for the detection of human carcinomas. One such approach involves the detection of tumors in vivo by tumor imaging techniques. According to this approach, the C35 antibody is labeled with an appropriate imaging reagent that produces a detectable signal. Examples of imaging reagents that can be used include, but at not limited to, radiolabels such as <131>I, <111>In, <123>I, <99m>Tc, <32>P, <125>I, <3>H, and <14>C, fluorescent labels such as fluorescein and rhodamine, and chemiluninescers such as luciferin. The antibody can be labeled with such reagents using techniques known in the art. For example, see Wensel and Meares, Radioimmunoimaging And Radioimmunotherapy, Elsevier, New York (1983) for techniques relating to the radiolabeling of antibodies [see also, Colcher et al., “Use of Monoclonal Antibodies as Radiopharmaceuticals for the Localization of Human Carcinoma Xenografts in Athymic Mice”, *Meth. Enzymol.* 121:80216 (1986)].

In the case of radiolabeled antibody, the antibody is administered to the patient, localizes to the tumor bearing the antigen with which the antibody reacts, and is detected or “imaged” in vivo using known techniques such as radionuclear scanning using, e.g., a gamma camera or emission tomography [see, e.g., Bradwell et al., “Developments In Antibody Imaging”, in *Monoclonal Antibodies for Cancer Detection and Therapy*, Baldwin, et al. (eds.), pp. 6585 (Academic Press 1985)]. the antibody is administered to the patient in a pharmaceutically acceptable carrier such as water, saline, Ringer’s solution, Hank’s solution or nonaqueous carriers such as fixed oils. The carrier may also contain substances that enhance isotonicity and chemical stability of the antibody such as buffers or preservatives. The antibody formulation is administered, for example, intravenously, at a dosage sufficient to provide enough gamma emission to allow visualization of the tumor target site. Sufficient time should be allowed between administration of the antibody and detection to allow for localization to the tumor target. For a general discussion of tumor imaging, see Allum et al, supra, at pp. 5155.

Therapeutic Applications of C35 Antibodies

The properties of the C35 antibody suggest a number of in vivo therapeutic applications.

First, the C35 antibody can be used alone to target and kill tumor cells in vivo. The antibody can also be used in conjunction with an appropriate therapeutic agent to treat human carcinoma. For example, the antibody can be used in combination with standard or conventional treatment methods such as chemotherapy, radiation therapy or can be conjugated or linked to a therapeutic drug, or toxin, as well as to a lymphokine or a tumorinhibitory growth factor, for delivery of the therapeutic agent to the site of the carcinoma.

Techniques for conjugating such therapeutic agents to antibodies are well known [see, e.g., Arnon et al., “Monoclonal Antibodies for Immunotargeting of Drugs in Cancer Therapy”, in *Monoclonal Antibodies and Cancer Therapy*, Reisfeld et al. (eds.), pp. 24356 (Alan R. Liss, Inc. 1985); Hellstrom et al., “Antibodies For Drug Delivery”, in *Controlled Drug Delivery* (2nd Ed.), Robinson et al. (eds.), pp. 62353 (Marcel Dekker, Inc. 1987); Thorpe, “Antibody Carriers Of Cytotoxic Agents In Cancer Therapy: A Review”, in *Monoclonal Antibodies ’84: Biological And Clinical Applications*, Pinchera et al. (eds.), pp. 475506 (1985); and Thorpe et al., “The Preparation And Cytotoxic Properties Of AntibodyToxin Conjugates”, Immunol. Rev., 62:11958 (1982)].

Alternatively, the C35 antibody can be coupled to highenergy radiation, e.g., a radioisotope such as <131>I, which, when localized at the tumor site, results in a killing of several cell diameters [see, e.g., Order, “Analysis, Results, and Future Prospective of The Therapeutic Use of Radiolabeled Antibody in Cancer Therapy”, in *Monoclonal Antibodies For Cancer Detection And Therapy*, Baldwin et al. (eds.), pp. 30316 (Academic Press 1985)]. According to yet another embodiment, the C35 antibody can be conjugated to a second antibody to form an antibody heteroconjugate for the treatment of tumor cells as described by Segal in U.S. Pat. No. 4,676,980.

Still other therapeutic applications for the C35 antibody of the invention include conjugation or linkage, e.g., by recombinant DNA techniques, to an enzyme capable of converting a prodrug into a cytotoxic drug and the use of that antibody-enzyme conjugate in combination with the prodrug to convert the prodrug to a cytotoxic agent at the tumor site [see, e.g., Senter et al., “AntiTumor Effects of Antibodyalkaline Phosphatase”, *Proc. Natl. Acad. Sci. USA* 85:484246 (1988); “Enhancement of the in vitro and in vivo Antitumor Activites of Phosphorylated Mitocycin C and Etoposide Derivatives by Monoclonal AntibodyAlkaline Phosphatase Conjugates”, Cancer Research 49:57895792 (1989); and Senter, “Activation of Prodrugs by AntibodyEnzyme Conjugates: A New Approach to Cancer Therapy,” *FASEB J.* 4:188193 (1990)].

Still another therapeutic use for the C35 antibody involves use, either in the presence of complement or as part of an antibodydrug or antibodytoxin conjugate, to remove tumor cells from the bone marrow of cancer patients. According to this approach, autologous bone marrow may be purged ex vivo by treatment with the antibody and the marrow infused back into the patient [see, e.g., Ramsay et al., “Bone Marrow Purging Using Monoclonal Antibodies”, J. Clin. Immunol., 8(2):8188 (1988)].

Furthermore, chimeric C35, recombinant immunotoxins and other recombinant constructs of the invention containing the specificity of the antigenbinding region of the C35 monoclonal antibody, as described earlier, may be used therapeutically. For example, the singlechain immunotoxins of the invention, may be used to treat human carcinoma in vivo.

Similarly, a fusion protein comprising at least the antigenbinding region of the C35 antibody joined to at least a functionally active portion of a second protein having antitumor activity, e.g., a lymphokine or oncostatin can be used to treat human carcinoma in vivo. Furthermore, recombinant techniques known in the art can be used to construct bispecific antibodies wherein one of the binding specificities of the antibody is that of C35, while the other binding specificity of the antibody is that of a molecule other than C35.

Finally, antiidiotypic antibodies of the C35 antibody may be used therapeutically in active tumor immunization and tumor therapy [see, e.g., Hellstrom et al., “Immunological Approaches To Tumor Therapy: Monoclonal Antibodies, Tumor Vaccines, And Antiudiotypes”, in Covalently Modified Antigens And Antibodies In Diagnosis And Therapy, supra at pp. 3541].

The present invention provides a method for selectively killing tumor cells expressing the antigen that specifically binds to the C35 monoclonal antibody or functional equivalent. This method comprises reacting the immunoconjugate (e.g. the immunotoxin) of the invention with said tumor cells. These tumor cells may be from a human carcinoma.

Additionally, this invention provides a method of treating carcinomas (for example human carcinomas) in vivo. This method comprises administering to a subject a pharmaceutically effective amount of a composition containing at least one of the immunoconjugates (e.g. the immunotoxin) of the invention.

In accordance with the practice of this invention, the subject may be a human, equine, porcine, bovine, murine, canine, feline, and avian subjects. Other warm blooded animals are also included in this invention.

The present invention also provides a method for curing a subject suffering from a cancer. The subject may be a human, dog, cat, mouse, rat, rabbit, horse, goat, sheep, cow, chicken. The cancer may be identified as a breast, bladder, retinoblastoma, papillary cystadenocarcinoma of the ovary, Wilm’s tumor, or small cell lung carcinoma and is generally characterized as a group of cells having tumor associated antigens on the cell surface. This method comprises administering to the subject a cancer killing amount of a tumor targeted antibody joined to a cytotoxic agent. Generally, the joining of the tumor targeted antibody with the cytotoxic agent is made under conditions which permit the antibody so joined to bind its target on the cell surface. By binding its target, the tumor targeted antibody acts directly or indirectly to cause or contribute to the killing of the cells so bound thereby curing the subject.

Also provided is a method of inhibiting the proliferation of mammalian tumor cells which comprises contacting the mammalian tumor cells with a sufficient concentration of the immunoconjugate of the invention so as to inhibit proliferation of the mammalian tumor cells.

The subject invention further provides methods for inhibiting the growth of human tumor cells, treating a tumor in a subject, and treating a proliferative type disease in a subject. These methods comprise administering to the subject an effective amount of the composition of the invention.

It is apparent therefore that the present invention encompasses pharmaceutical compositions, combinations and methods for treating human carcinomas. For example, the invention includes pharmaceutical compositions for use in the treatment of human carcinomas comprising a pharmaceutically effective amount of a C35 antibody and a pharmaceutically acceptable carrier.

The compositions may contain the C35 antibody or antibody fragments, either unmodified, conjugated to a therapeutic agent (e.g., drug, toxin, enzyme or second antibody) or in a recombinant form (e.g., chimeric C35, fragments of chimeric C35, bispecific C35 or singlechain immunotoxin C35). The compositions may additionally include other antibodies or conjugates for treating carcinomas (e.g., an antibody cocktail).

The antibody, antibody conjugate and immunotoxin compositions of the invention can be administered using conventional modes of administration including, but not limited to, intravenous, intraperitoneal, oral, intralymphatic or administration directly into the tumor. Intravenous administration is preferred.

The compositions of the invention may be in a variety of dosage forms which include, but are not limited to, liquid solutions or suspension, tablets, pills, powders, suppositories, polymeric microcapsules or microvesicles, liposomes, and injectable or infusible solutions. The preferred form depends upon the mode of administration and the therapeutic application.

The compositions of the invention also preferably include conventional pharmaceutically acceptable carriers and adjuvants known in the art such as human serum albumin, ion exchangers, alumina, lecithin, buffer substances such as phosphates, glycine, sorbic acid, potassium sorbate, and salts or electrolytes such as protamine sulfate.

The most effective mode of administration and dosage regimen for the compositions of this invention depends upon the severity and course of the disease, the patient's health and response to treatment and the judgment of the treating physician. Accordingly, the dosages of the compositions should be titrated to the individual patient. Nevertheless, an effective dose of the compositions of this invention may be in the range of from about 1 to about 2000 mg/kg.

The molecules described herein may be in a variety of dosage forms which include, but are not limited to, liquid solutions or suspensions, tablets, pills, powders, suppositories, polymeric microcapsules or microvesicles, liposomes, and injectable or infusible solutions. The preferred form depends upon the mode of administration and the therapeutic application.

The most effective mode of administration and dosage regimen for the molecules of the present invention depends upon the location of the tumor being treated, the severity and course of the cancer, the subject's health and response to treatment and the judgment of the treating physician. Accordingly, the dosages of the molecules should be titrated to the individual subject.

The interrelationship of dosages for animals of various sizes and species and humans based on mg/kg of surface area is described by Freireich, E. J., et al. Cancer Chemother., Rep. 50 (4): 219244 (1966). Adjustments in the dosage regimen may be made to optimize the tumor cell growth inhibiting and killing response, e.g., doses may be divided and administered on a daily basis or the dose reduced proportionally depending upon the situation (e.g., several divided doses may be administered daily or proportionally reduced depending on the specific therapeutic situation.

It would be clear that the dose of the composition of the invention required to achieve cures may be further reduced with schedule optimization.

In accordance with the practice of the invention, the pharmaceutical carrier may be a lipid carrier. The lipid carrier may be a phospholipid. Further, the lipid carrier may be a fatty acid. Also, the lipid carrier may be a detergent. As used herein, a detergent is any substance that alters the surface tension of a liquid, generally lowering it.

In one example of the invention, the detergent may be a nonionic detergent. Examples of nonionic detergents include, but are not limited to, polysorbate 80 (also known as Tween 80 or (polyoxyethylenesorbitan monooleate), Brij, and Triton (for example Triton WR1339 and Triton A20).

Alternatively, the detergent may be an ionic detergent. An example of an ionic detergent includes, but is not limited to, alkyltrimethylammonium bromide.

Additionally, in accordance with the invention, the lipid carrier may be a liposome. As used in this application, a "liposome" is any membrane bound vesicle which contains any molecules of the invention or combinations thereof.

Vaccine Formulations

The C35 epitopes can be produced in quantity by recombinant DNA methods and formulated with an adjuvant that promotes a cell-mediated immune response. The present invention encompasses the expression of the C35 polypeptides, or C35 epitopes (including cytotoxic or helper T cell eliciting epitopes), in either eucaryotic or procaryotic recombinant expression vectors; and the formulation of the same as immunogenic and/or antigenic compositions. Such compositions are described in, for example, U.S. patent application Ser. No. 08/935,377, the entire contents of which are incorporated herein by reference. In accordance with the present invention, the recombinantly expressed C35 epitope may be expressed, purified and formulated as a subunit vaccine. Preferably, the DNA encoding the C35 epitope may also be constructed into viral vectors, preferably pox virus, adenovirus, herpesvirus, and alphavirus vectors, for use in vaccines. In this regard, either a live recombinant viral vaccine, an inactivated recombinant viral vaccine, or a killed recombinant viral vaccine can be formulated.

(i) Expression of C35 in Procaryotic and Eucaryotic Expression Systems

The present invention encompasses expression systems, both eucaryotic and procaryotic expression vectors, which may be used to express the C35 epitope. The C35 epitope may be expressed in both truncated or full-length forms, in particular for the formation of subunit vaccines.

The present invention encompasses the expression of nucleotide sequences encoding the C35 polypeptide and immunologically equivalent fragments. Such immunologically equivalent fragments may be identified by making analogs of the nucleotide sequence encoding the identified epitopes that are truncated at the 5' and/or 3' ends of the sequence and/or have one or more internal deletions, expressing the analog nucleotide sequences, and determining whether the resulting fragments immunologically are recognized by the epitope-specific T lymphocytes and induce a cell-mediated immune response, or epitope-specific B lymphocytes for inductions of a humoral immune response.

The invention encompasses the DNA expression vectors that contain any of the foregoing coding sequences operatively associated with a regulatory element that directs expression of the coding sequences and genetically engineered host cells that contain any of the foregoing coding sequences operatively associated with a regulatory element that directs the expression of the coding sequences in the host cell. As used herein, regulatory elements include but are not limited to, inducible and non-inducible promoters, enhancers, operators and other elements known to those skilled in the art that drive and regulate expression.

The C35 epitope gene products or peptide fragments thereof, may be produced by recombinant DNA technology using techniques well known in the art. Thus, methods for preparing the C35 epitope gene polypeptides and peptides of the invention by expressing nucleic acid containing epitope gene sequences are described herein. Methods which are well known to those skilled in the art can be used to construct expression vectors containing epitope gene product coding sequences and appropriate transcriptional and translational control signals. These methods include, for example, in vitro recombinant DNA techniques, synthetic techniques, and in vivo genetic recombination. See, for example, the techniques described in Sambrook et al., Molecular Cloning: A Laboratory Manual, 2nd Ed., (1989), Cold Spring Harbor Laboratory Press, and Ausubel et al., 1989, supra. Alternatively, RNA capable of encoding glycoprotein epitope gene product sequences may be chemically synthesized using, for example, synthesizers. See, for example, the techniques described in "Oligonucleotide Synthesis", 1984, Gait, M. J. ed., IRL Press, Oxford, which is incorporated by reference herein in its entirety.

The invention also encompasses nucleotide sequences that encode peptide fragments of the C35 epitope gene products. For example, polypeptides or peptides corresponding to the extracellular domain of the C35 epitope may be useful as "soluble" protein which would facilitate secretion, particularly useful in the production of subunit vaccines. The C35 epitope gene product or peptide fragments thereof, can be linked to a heterologous epitope that is recognized by a commercially available antibody is also included in the invention. A durable fusion protein may also be engineered; i.e., a fusion protein which has a cleavage site located between the C35 epitope sequence and the heterologous protein sequence, so that the selected C35 can be cleaved away from the heterologous moiety. For example, a collagenase cleavage recognition consensus sequence may be engineered between the C35 epitope protein or peptide and the heterologous peptide or protein. The epitopic domain can be released from this fusion protein by treatment with collagenase. In a preferred embodiment of the invention, a fusion protein of glutathione-S-transferase and the C35 epitope protein may be engineered.

The C35 epitope proteins of the present invention for use in vaccine preparations, in particular subunit vaccine preparations, are substantially pure or homogeneous. The protein is considered substantially pure or homogeneous when at least 60 to 75% of the sample exhibits a single polypeptide sequence. A substantially pure protein will preferably comprise 60 to 90% of a protein sample, more preferably about 95% and most preferably 99%. Methods which are well known to those skilled in the art can be used to determine protein purity or homogeneity, such as polyacrylamide gel electrophoresis of a sample, followed by visualizing a single polypeptide band on a staining gel. Higher resolution may be determined using HPLC or other similar methods well known in the art.

The present invention encompasses C35 polypeptides which are typically purified from host cells expressing recombinant nucleotide sequences encoding these proteins. Such protein purification can be accomplished by a variety of methods well known in the art. In a preferred embodiment, the C35 epitope protein of the present invention is expressed as a fusion protein with glutathione-S-transferase. The resulting recombinant fusion proteins purified by affinity chromatography and the epitope protein domain is cleaved away from the heterologous moiety resulting in a substantially pure protein sample. Other methods known to those skilled in the art may be used; see for example, the techniques described in "Methods In Enzymology", 1990, Academic Press, Inc., San Diego, "Protein Purification: Principles and Practice", 1982, Springer-Verlag, New York, which are incorporated by reference herein in their entirety.

(ii) Eucaryotic and Procaryotic Expression Vectors

The present invention encompasses expression systems, both eucaryotic and procaryotic expression vectors, which may be used to express the C35 epitope. A variety of host-expression vector systems may be utilized to express the C35 epitope gene of the invention. Such host-expression systems represent vehicles by which the C35 coding sequence may be produced and subsequently purified, but also represent cells which may, when transformed or transfected with the C35 nucleotide coding sequences, exhibit the C35 epitope gene product of the invention in situ. These include but are not limited to microorganisms such as bacteria (e.g., *E. coli, B. subtilis*) transformed with recombinant bacteriophage DNA, plasmid DNA or cosmid DNA expression vectors containing the C35 epitope gene product coding sequence; yeast (e.g., *Saccharomyces, Pichia*) transformed with recombinant yeast expression vectors containing the C35 epitope gene product coding sequence; insect cell systems infected with recombinant virus expression vectors (e.g., baculovirus) containing the C35 epitope gene product coding sequence; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing C35 epitope gene product coding sequence; or mammalian cell systems (e.g., COS, CHO, BHK, 293, 3T3) harboring recombinant expression constructs containing promoters derived from the genome of mammalian cells (e.g., metallothionein promoter) or from mammalian viruses (e.g., the adenovirus late promoter; the vaccinia virus 7.5K promoter).

(iii) Host Cells

The present invention encompasses the expression of the C35 epitope in animal and insect cell lines. In a preferred embodiment of the present invention, the C35 epitope is expressed in a baculovirus vector in an insect cell line to produce an unglycosylated antigen. In another preferred embodiment of the invention, the C35 epitope is expressed in a stably transfected mammalian host cell, e.g., CHO cell line to produce a glycosylated antigen. The C35 epitopes which are expressed recombinantly by these cell lines may be formulated as subunit vaccines. The present invention is further directed to host cells that overexpress the C35 gene product. The cell may be a host cell transiently or stable transected or transformed with any suitable vector which includes a polynucleotide sequence encoding the C35 polypeptide or a fragment thereof and suitable promoter and enhancer sequences to direct overexpression of the C35 gene product. However, the overexpressing cell may also be a product of an insertion, for example via homologous recombination, of a heterologous promoter or enhancer which will direct overexpression of the endogenous C35 gene. The term "overexpression" refers to a level of expression which is higher than a basal level of expression typically characterizing a given cell under otherwise identical conditions.

A host cell strain may be chosen which modulates the expression of the inserted sequences, or modifies and processes the C35 gene product in the specific fashion desired. Such modifications (e.g., glycosylation) and processing (e.g. cleavage) of protein products may be important for the function of the protein. Different host cells have characteristic and specific mechanisms for the post-translational processing and modification of proteins and gene products. Appropriate cell lines or host systems can be chosen to ensure the correct modification of the foreign protein expressed. To this end, eucaryotic host cells which possess the cellular machinery for proper processing of the primary transcript, glycosylation, phosphorylation, and prenylation of the C35 gene product may be used. Such mammalian host cells include but are not limited to CHO, VERO, BHK, HeLa, COS, MDCK, 293, 3T3 and WI38 cell lines.

For long term, high-yield production of recombinant proteins, stable expression is preferred. For example, cell lines which stably express the C35 target epitope may be engineered. Rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines. This method may advantageously be used to engineer cell lines which express the C35 epitope gene products. Such cell lines would be particularly useful in screening and evaluation of compounds that affect the endogenous activity of the C35 epitope gene product.

A number of selection systems may be used, including but not limited to the herpes simplex virus thymidine kinase (Wigler, et al., 1977, *Cell* 11:223), hypoxanthine-guanine phosphoribosyltransferase (Szybalska & Szybalski, 1962, *Proc. Natl. Acad. Sci. USA* 48:2026), and adenine phosphoribosyltransferase (Lowy, et al., 1980, *Cell* 22:817) genes can be employed in $tk^-$, $hgprt^-$ or $aprt^-$ cells, respectively. Also, antimetabolite resistance can be used as the basis of selection for the following genes: dhfr, which confers resistance to methotrexate (Wigler, et al., 1980, *Proc. Natl. Acad. Sci. USA* 77:3567; O'Hare, et al., 1981, *Proc. Natl. Acad. Sci. USA* 78:1527); gpt, which confers resistance to mycophenolic acid (Mulligan & Berg, 1981, *Proc. Natl. Acad. Sci. USA* 78:2072); neo, which confers resistance to the aminoglycoside G-418 (Colberre-Garapin, et al., 1981, *J. Mol. Biol.* 150:1); and hygro, which confers resistance to hygromycin (Santerre, et al., 1984, *Gene* 30:147).

Alternatively, any fusion protein may be readily purified by utilizing an antibody specific for the fusion protein being expressed. For example, a system described by Janknecht et al. allows for the ready purification of non-denatured fusion proteins expressed in human cell lines (Janknecht, et al., 1991, *Proc. Natl. Acad. Sci. USA* 88: 8972-8976). In this system, the gene of interest is subcloned into a vaccinia recombination plasmid such that the gene's open reading frame is translationally fused to an amino-terminal tag consisting of six histidine residues. Extracts from cells infected with recombinant vaccinia virus are loaded onto $Ni^{2+}$ nitriloacetic acid-agarose columns and histidine-tagged proteins are selectively eluted with imidazole-containing buffers.

(iv) Expression of C35 Epitope in Recombinant Viral Vaccines

In another embodiment of the present invention, either a live recombinant viral vaccine or an inactivated recombinant viral vaccine expressing the C35 epitope can be engineered. A live vaccine may be preferred because multiplication in the host leads to a prolonged stimulus of similar kind and magnitude to that occurring in natural infections, and therefore, confers substantial, long-lasting immunity. Production of such live recombinant virus vaccine formulations may be accomplished using conventional methods involving propagation of the virus in cell culture or in the allantois of the chick embryo followed by purification.

In this regard, a variety of viruses may be genetically engineered to express the C35 epitope. For vaccine purposes, it may be required that the recombinant viruses display attenuation characteristics. Current live virus vaccine candidates for use in humans are either cold adapted, temperature sensitive, or attenuated. The introduction of appropriate mutations (e.g., deletions) into the templates used for transfection may provide the novel viruses with attenuation characteristics. For example, specific multiple missense mutations that are associated with temperature sensitivity or cold adaptation can be made into deletion mutations and/or multiple mutations can be introduced into individual viral genes. These mutants should be more stable than the cold or temperature sensitive mutants containing single point mutations and reversion frequencies should be extremely low. Alternatively, recombinant viruses with "suicide" characteristics may be constructed. Such viruses go through only one or a few rounds of replication in the host.

For purposes of the invention, any virus may be used in accordance with the present invention which: (a) displays an attenuated phenotype or may be engineered to display attenuated characteristics; (b) displays a tropism for mammals, in particular humans, or may be engineered to display such a tropism; and (c) may be engineered to express the C35 epitope of the present invention.

Vaccinia viral vectors may be used in accordance with the present invention, as large fragments of DNA are easily cloned into its genome and recombinant attenuated vaccinia variants have been described (Meyer, et al., 1991, *J. Gen. Virol.* 72:1031-1038). Orthomyxoviruses, including influenza; Paramyxoviruses, including respiratory syncytial virus and Sendai virus; and Rhabdoviruses may be engineered to express mutations which result in attenuated phenotypes (see U.S. Pat. No. 5,578,473, issued Nov. 26, 1996). These viral genomes may also be engineered to express foreign nucleotide sequences, such as the C35 epitopes of the present invention (see U.S. Pat. No. 5,166,057, issued Nov. 24, 1992, incorporated herein by reference in its entirety). Reverse genetic techniques can be applied to manipulate negative and positive strand RNA viral genomes to introduce mutations which result in attenuated phenotypes, as demonstrated in influenza virus, Herpes Simplex virus, cytomegalovirus and Epstein-Barr virus, Sindbis virus and poliovirus (see Palese et al., 1996, *Proc. Natl. Acad. Sci. USA* 93:11354-11358). These techniques may also be utilized to introduce foreign DNA, i.e., the C35 epitopes, to create recombinant viral vectors to be used as vaccines in accordance with the present invention. See, for instance, U.S. patent application Ser. No. 08/935, 377, the entire contents of which are incorporated herein by reference. In addition, attenuated adenoviruses and retroviruses may be engineered to express the C35 epitope. Therefore, a wide variety of viruses may be engineered to design the vaccines of the present invention, however, by way of example, and not by limitation, recombinant attenuated vaccinia vectors expressing the C35 epitope for use as vaccines are described herein.

In one embodiment, a recombinant modified vaccinia variant, Modified Virus Ankara (MVA) is used in a vaccine formulation. This modified virus has been passaged for 500 cycles in avian cells and is unable to undergo a full infectious cycle in mammalian cells (Meyer, et al., 1991, *J. Gen. Virol.* 72:1031-1038). When used as a vaccine, the recombinant virus goes through a single replication cycle and induces a sufficient level of immune response but does not go further in the human host and cause disease. Recombinant viruses lacking one or more of essential vaccinia virus genes are not able to undergo successive rounds of replication. Such defective viruses can be produced by co-transfecting vaccinia vectors lacking a specific gene(s) required for viral replication into cell lines which permanently express this gene(s). Viruses lacking an essential gene(s) will be replicated in these cell lines but when administered to the human host will not be able to complete a round of replication. Such preparations may transcribe and translate—in this abortive cycle—a sufficient number of genes to induce an immune response.

Alternatively, larger quantities of the strains can be administered, so that these preparations serve as inactivated (killed) virus, vaccines. For inactivated vaccines, it is preferred that the heterologous C35 gene product be expressed as a viral component, so that the C35 gene product is associated with the virion. The advantage of such preparations is that they contain native proteins and do not undergo inactivation by treatment with formalin or other agents used in the manufacturing of killed virus vaccines.

In another embodiment of the invention, inactivated vaccine formulations are prepared using conventional techniques to "kill" the recombinant viruses. Inactivated vaccines are "dead" in the sense that their infectivity has been destroyed. Ideally, the infectivity of the virus is destroyed without affecting immunogenicity. In order to prepare inactivated vaccines, the recombinant virus may be grown in cell culture or in the allantois of the chick embryo, purified by zonal ultracentrifugation, inactivated by formaldehyde or β-propiolactone, and pooled. The resulting vaccine is usually inoculated intramuscularly.

Inactivated viruses may be formulated with a suitable adjuvant in order to enhance the immunological response. Such adjuvants may include but are not limited to mineral gels, e.g., aluminum hydroxide; surface active substances such as lysolecithin, pluronic polyols, polyanions; peptides; oligonucleotides, oil emulsions; and potentially useful human adjuvants such as BCG and *Corynebacterium parvum*.

(v) Methods of Treatment and/or Vaccination

Since the C35 epitopes of the present invention can be produced in large amounts, the antigen thus produced and purified has use in vaccine preparations. The C35 epitope may be formulated into a subunit vaccine preparation, or may be engineered into viral vectors and formulated into vaccine preparations. Alternatively, the DNA encoding the C35 epitope may be administered directly as a vaccine formulation. The "naked" plasmid DNA once administered to a subject invades cells, is expressed, processed into peptide fragments, some of which can be presented in association with MHC molecules on the surface of the invaded cell, and elicits a cellular immune response so that T lymphocytes will attack cells displaying the C35 epitope. The C35 epitope also has utility in diagnostics, e.g., to detect or measure in a sample of body fluid from a subject the presence of tumors that express C35 or the presence of antibodies or T cells that have been induced by C35 expressing tumor and thus to diagnose cancer and tumors and/or to monitor the cellular immune response of the subject subsequent to vaccination.

The recombinant viruses of the invention can be used to treat tumor-bearing mammals, including humans, to generate an immune response against the tumor cells. The generation of an adequate and appropriate immune response leads to tumor regression in vivo. Such "vaccines" can be used either alone or in combination with other therapeutic regimens, including but not limited to chemotherapy, radiation therapy, surgery, bone marrow transplantation, etc. for the treatment of tumors. For example, surgical or radiation techniques could be used to debulk the tumor mass, after which, the vaccine formulations of the invention can be administered to ensure the regression and prevent the progression of remaining tumor masses or micrometastases in the body. Alternatively, administration of the "vaccine" can precede such surgical, radiation or chemotherapeutic treatment.

Alternatively, the recombinant viruses of the invention can be used to immunize or "vaccinate" tumor-free subjects to prevent tumor formation. With the advent of genetic testing, it is now possible to predict a subject's predisposition for certain cancers. Such subjects, therefore, may be immunized using a recombinant vaccinia virus expressing the C35 antigen.

The immunopotency of the C35 epitope vaccine formulations can be determined by monitoring the immune response in test animals following immunization or by use of any immunoassay known in the art. Generation of a cell-mediated and/or humoral immune response may be taken as an indication of an immune response. Test animals may include mice, hamsters, dogs, cats, monkeys, rabbits, chimpanzees, etc., and eventually human subjects.

Suitable preparations of such vaccines include injectables, either as liquid solutions or suspensions; solid forms suitable for solution in, suspension in, liquid prior to injection, may also be prepared. The preparation may also be emulsified, or the polypeptides encapsulated in liposomes. The active immunogenic ingredients are often mixed with excipients which are pharmaceutically acceptable and compatible with the active ingredient. Suitable excipients are, for example, water, saline, dextrose, glycerol, ethanol, or the like and combinations thereof. In addition, if desired, the vaccine preparation may also include minor amounts of auxiliary substances such as wetting or emulsifying agents, pH buffering agents, and/or adjuvants which enhance the effectiveness of the vaccine.

Examples of adjuvants which may be effective, include, but are not limited to: aluminum hydroxide, N-acetyl-muramyl-L-threonyl-D-isoglutamine (thr-MDP), N-acetyl-normuramyl-L-alanyl-D-isoglutamine, N-acetylmuramyl-L-alanyl-D-isoglutaminyl-L-alanine-2-(1'-2'-dipalmitoyl-sn-glycero-3-hydroxyphosphoryloxy)-ethylamine, GM-CSF, QS-21™ (investigational drug, Progenics Pharmaceuticals, Inc.), DETOX™ (investigational drug, Ribi Pharmaceuticals), BCG, and CpG rich oligonucleotides.

The effectiveness of an adjuvant may be determined by measuring the induction of the cellular immune response directed against the C35 epitope.

The vaccines of the invention may be multivalent or univalent. Multivalent vaccines are made from recombinant viruses that direct the expression of more than one antigen. Multivalent vaccines comprised of multiple T cell epitopes, both cytotoxic and helper, are preferred.

The composition, if desired, can also contain minor amounts of wetting or emulsifying agents, or pH buffering agents. The composition can be a liquid solution, suspension, emulsion, tablet, pill, capsule, sustained release formulation, or powder. Oral formulation can include standard carriers such as pharmaceutical grades of mannitol, lactose, starch, magnesium stearate, sodium saccharine, cellulose, magnesium carbonate, etc.

Generally, the ingredients are supplied either separately or mixed together in unit dosage form, for example, as a dry lyophilized powder or water free concentrate in a hermetically sealed container such as an ampoule or sachette indicating the quantity of active agent. Where the composition is administered by injection, an ampoule of sterile diluent can be provided so that the ingredients may be mixed prior to administration.

In a specific embodiment, a lyophilized C35 epitope of the invention is provided in a first container; a second container comprises diluent consisting of an aqueous solution of 50% glycerin, 0.25% phenol, and an antiseptic (e.g., 0.005% brilliant green).

Use of purified C35 antigens as vaccine preparations can be carried out by standard methods. For example, the purified C35 epitopes should be adjusted to an appropriate concentration, formulated with any suitable vaccine adjuvant and packaged for use. Suitable adjuvants may include, but are not limited to: mineral gels, e.g., aluminum hydroxide; surface active substances such as lysolecithin, pluronic polyols; polyanions; peptides; oil emulsions; alum, and MDP. The immunogen may also be incorporated into liposomes, or conjugated to polysaccharides and/or other polymers for use in a vaccine formulation. In instances where the recombinant antigen is a hapten, i.e., a molecule that is antigenic in that it can react selectively with cognate antibodies, but not immunogenic in that it cannot elicit an immune response, the hapten may be covalently bound to a carrier or immunogenic molecule; for instance, a large protein such as serum albumin will confer immunogenicity to the hapten coupled to it. The hapten-carrier may be formulated for use as a vaccine.

Many methods may be used to introduce the vaccine formulations described above into a patient. These include, but are not limited to, oral, intradermal, intramuscular, intraperitoneal, intravenous, subcutaneous, intranasal, transdermal, epidural, pulmonary, gastric, intestinal, rectal, vaginal, or urethral routes. When the method of treatment uses a live recombinant vaccinia vaccine formulation of the invention, it may be preferable to introduce the formulation via the natural route of infection of the vaccinia virus, i.e., through a mucosal membrane or surface, such as an oral, nasal, gastric, intestinal, rectal, vaginal or urethral route, or through the skin. To induce a CTL response, the mucosal route of administration may be through an oral or nasal membrane. Alternatively, an intramuscular or intraperitoneal route of administration may be used. Preferably, a dose of $10^6$-$10^7$ PFU (plaque forming units) of cold adapted recombinant vaccinia virus is given to a human patient.

The precise dose of vaccine preparation to be employed in the formulation will also depend on the route of administration, and the nature of the patient, and should be decided according to the judgment of the practitioner and each patient's circumstances according to standard clinical techniques. An effective immunizing amount is that amount sufficient to produce an immune response to the antigen in the host to which the vaccine preparation is administered.

Where subsequent or booster doses are required, a modified vaccinia virus such as MVA can be selected as the parental virus used to generate the recombinant. Alternatively, another virus, e.g., adenovirus, canary pox virus, or a subunit preparation can be used to boost. Immunization and/or cancer immunotherapy may be accomplished using a combined immunization regimen, e.g., immunization with a recombinant vaccinia viral vaccine of the invention and a boost of a recombinant adenoviral vaccine. In such an embodiment, a strong secondary $CD8^+$ T cell response is induced after priming and boosting with different viruses expressing the same epitope (for such methods of immunization and boosting, see, e.g., Murata et al., Cellular Immunol. 173:96-107). For example, a patient is first primed with a vaccine formulation of the invention comprising a recombinant vaccinia virus expressing an epitope, e.g., a selected tumor-associated antigen or fragment thereof. The patient is then boosted, e.g., 21 days later, with a vaccine formulation comprising a recombinant virus other than vaccinia expressing the same epitope. Such priming followed by boosting induces a strong secondary T cell response. Such a priming and boosting immunization regimen is preferably used to treat a patient with a tumor, metastasis or neoplastic growth expressing the tumor associate, e.g., C35, antigen In yet another embodiment, the recombinant vaccinia viruses can be used as a booster immunization subsequent to a primary immunization with inactivated tumor cells, a subunit vaccine containing the C35 antigen or its epitope, or another recombinant viral vaccine, e.g., adenovirus, canary pox virus, or MVA.

In an alternate embodiment, recombinant vaccinia virus encoding C35 epitopes or fragment thereof may be used in adoptive immunotherapeutic methods for the activation of T lymphocytes that are histocompatible with the patient and specific for the C35 antigen (for methods of adoptive immunotherapy, see, e.g., Rosenberg, U.S. Pat. No. 4,690,915, issued Sep. 1, 1987; Zarling, et al., U.S. Pat. No. 5,081,029, issued Jan. 14, 1992). Such T lymphocytes may be isolated from the patient or a histocompatible donor. The T lymphocytes are activated in vitro by exposure to the recombinant vaccinia virus of the invention. Activated T lymphocytes are expanded and inoculated into the patient in order to transfer T cell immunity directed against the C35 antigen epitope.

The invention also provides a pharmaceutical pack or kit comprising one or more containers comprising one or more of the ingredients of the vaccine formulations of the invention. Associated with such container(s) can be a notice in the form prescribed by a governmental agency regulating the manufacture, use or sale of pharmaceuticals or biological products, which notice reflects approval by the agency of manufacture, use or sale for human administration.

Cancer Diagnosis and Prognosis

There are two classes of genes affecting tumor development. Genes influencing the cancer phenotype that act directly as a result of changes (e.g., mutation) at the DNA level, such as BRCA1, BRCA2, and p53, are one class of genes. Another class of genes affect the phenotype by modulation at the expression level. Development of breast cancer and subsequent malignant progression is associated with alterations of a variety of genes of both classes. Identification of quantitative changes in gene expression that occur in the malignant mammary gland, if sufficiently characterized, may yield novel molecular markers which may be useful in the diagnosis and treatment of human breast cancer.

The present inventors have identified a new breast cancer marker, C35, that is differentially expressed in primary infiltrating intraductal mammary carcinoma cells. Low expression levels of C35 in normal mammary epithelial cells suggest that overexpression of C35 indicates breast cancer malignant progression. It is possible that C35 may also be overexpressed in tumors of certain other tissue types including bladder and lung.

The present inventors have demonstrated that certain tissues in mammals with cancer express significantly enhanced levels of the C35 protein and mRNA encoding the C35 protein when compared to a corresponding "standard" mammal, i.e., a mammal of the same species not having the cancer. Further, it is believed that enhanced levels of the C35 protein, or of antibodies or lymphocytes specific for the C35 protein, can be detected in certain body fluids (e.g., sera, plasma, urine, and spinal fluid) from mammals with cancer when compared to sera from mammals of the same species not having the cancer. Thus, the present invention provides a diagnostic method useful for tumor diagnosis, which involves assaying the expression level of the gene encoding the C35 protein in mammalian cells or body fluid and comparing the gene expression level with a standard C35 gene expression level, whereby an increase in the gene expression level over the standard is indicative of certain tumors. Alternatively, the expression levels of antibodies or lymphocytes specific for C35 protein or C35 polypeptides can be determined in blood or other body fluids and compared with a standard of expression of C35-specific antibodies or lymphocytes.

Where a tumor diagnosis has already been made according to conventional methods, the present invention is useful as a prognostic indicator, whereby patients exhibiting enhanced C35 gene expression may experience a worse clinical outcome relative to patients expressing the gene at a lower level.

By "assaying the expression level of the gene encoding the C35 protein" is intended qualitatively or quantitatively measuring or estimating the level of the C35 protein or the level of the mRNA encoding the C35 protein in a first biological sample either directly (e.g., by determining or estimating absolute protein level or mRNA level) or relatively (e.g., by comparing to the C35 protein level or mRNA level in a second biological sample).

Preferably, the C35 protein level or mRNA level in the first biological sample is measured or estimated and compared to a standard C35 protein level or mRNA level, the standard being taken from a second biological sample obtained from an individual not having the cancer. As will be appreciated in the art, once a standard C35 protein level or mRNA level is known, it can be used repeatedly as a standard for comparison.

By "biological sample" is intended any biological sample obtained from an individual, cell line, tissue culture, or other source which contains C35 protein or mRNA. Biological samples include mammalian body fluids (such as sera, plasma, urine, synovial fluid and spinal fluid) which contain secreted mature C35 protein, and ovarian, prostate, heart, placenta, pancreas, liver, spleen, lung, breast, bladder and umbilical tissue which may contain precursor or mature forms of C35.

The present invention is useful for detecting cancer in mammals. In particular, the invention is useful during diagnosis of the following types of cancers in mammals: breast, bladder, ovarian, prostate, bone, liver, lung, pancreatic, and splenic. Preferred mammals include monkeys, apes, cats, dogs, cows, pigs, horses, rabbits and humans. Particularly preferred are humans.

Total cellular RNA can be isolated from a biological sample using the single-step guanidinium-thiocyanate-phenol-chloroform method described in Chomczynski and Sacchi, *Anal. Biochem.* 162:156-159 (1987). Levels of mRNA encoding the C35 protein are then assayed using any appropriate method. These include Northern blot analysis (Harada et al., *Cell* 63:303-312 (1990)), S1 nuclease mapping (Fujita et al., *Cell* 49:357-367 (1987)), the polymerase chain reaction (PCR), reverse transcription in combination with the polymerase chain reaction (RT-PCR) (Makino et al., *Technique* 2:295-301 (1990)), and reverse transcription in combination with the ligase chain reaction (RT-LCR).

Assaying C35 protein levels in biological sample can occur using antibody-based techniques. For example, C35 protein expression in tissues can be studied with classical immunohistological methods (Jalkanen, M., et al., *J. Cell. Biol.* 101: 976-985 (1985); Jalkanen, M., et al., *J. Cell. Biol.* 105:3087-3096 (1987)).

Other antibody-based methods useful for detecting C35 protein expression include immunoassays, such as enzyme linked immunosorbent assay (ELISA), ELISPOT, and the radioimmunoassay (RIA).

Suitable labels are known in the art and include enzyme labels, such as, Glucose oxidase, and radioisotopes, such as iodine ($^{125}I$, $^{121}I$), carbon ($^{14}C$), sulfur ($^{35}S$), tritium ($^{3}H$), indium ($^{112}In$), and technetium ($^{99m}Tc$), and fluorescent labels, such as fluorescein and rhodamine, and biotin.

C35-specific T cells may be detected in a variety of proliferation and lymphokine secretion assays following activation by C35 presented by antigen presenting cells according to methods known in the art. Tetrameric complexes of a C35 peptide epitope bound to soluble MHC molecules can be employed to directly stain and enumerate C35-specific T cells in a population of cells (Lee, P. P. et al., *Nature Medicine* 5:677-85 (1999) the entire contents of which is hereby incorporated by reference.

In addition to assaying secreted protein levels in a biological sample, proteins can also be detected in vivo by imaging. Antibody labels or markers for in vivo imaging of protein include those detectable by Xradiography, NMR or ESR. For Xradiography, suitable labels include radioisotopes such as barium or cesium, which emit detectable radiation but are not overtly harmful to the subject. Suitable markers for NMR and ESR include those with a detectable characteristic spin, such as deuterium, which may be incorporated into the antibody by labeling of nutrients for the relevant hybridoma.

A proteinspecific antibody or antibody fragment which has been labeled with an appropriate detectable imaging moiety, such as a radioisotope (for example, $^{131}I$, $^{112}In$, $^{99}mTc$), a radioopaque substance, or a material detectable by nuclear magnetic resonance, is introduced (for example, parenterally, subcutaneously, or intraperitoneally) into the mammal. It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of 99 mTc. The labeled antibody or antibody fragment will then preferentially accumulate at the location of cells which contain the specific protein. In vivo tumor imaging is described in S. W. Burchiel et al., "Immunopharmacokinetics of Radiolabeled Antibodies and Their Fragments." (Chapter 13 in *Tumor Imaging: The Radiochemical Detection of Cancer*, S. W. Burchiel and B. A. Rhodes, eds., Masson Publishing Inc. (1982).)

Fusion Proteins

Any C35 polypeptide can be used to generate fusion proteins. For example, the C35 polypeptide, when fused to a second protein, can be used as an antigenic tag. Antibodies raised against the C35 polypeptide can be used to indirectly detect the second protein by binding to the C35. Moreover, because secreted proteins target cellular locations based on trafficking signals, the C35 polypeptides can be used as a targeting molecule once fused to other proteins. As used herein, the term "fusion protein" does not mean C35 polypeptide fragments.

Examples of domains that can be fused to C35 polypeptides include not only heterologous signal sequences, but also other heterologous functional regions. The fusion does not necessarily need to be direct, but may occur through linker sequences. In a preferred embodiment, the fusion protein of the present invention comprises at least one C35 peptide epitope or C35 peptide epitope analog joined to at least one additional C35 peptide epitope or C35 peptide epitope analog. In a particularly preferred embodiment, the fusion proteins of the present invention comprise homopolymers of the same C35 peptide epitope or C35 peptide epitope analog, as well as heteropolymers of different C35 peptide epitopes and C35 peptide epitope analogs.

In certain preferred embodiments, C35 fusion polypeptides may be constructed which include additional Nterminal and/or Cterminal amino acid residues. In particular, any Nterminally or Cterminally deleted C35 polypeptide disclosed herein may be altered by inclusion of additional amino acid residues at the Nterminus to produce a C35 fusion polypeptide. In addition, C35 fusion polypeptides are contemplated which include additional Nterminal and/or Cterminal amino acid residues fused to a C35 polypeptide comprising any combination of N- and Cterminal deletions set forth above.

Moreover, fusion proteins may also be engineered to improve characteristics of the C35 polypeptide. For instance, a region of additional amino acids, particularly charged amino acids, may be added to the Nterminus of the C35 polypeptide to improve stability and persistence during purification from the host cell or subsequent handling and storage. Also, peptide moieties may be added to the C35 polypeptide to facilitate purification. Such regions may be removed prior to final preparation of the C35 polypeptide. The addition of peptide moieties to facilitate handling of polypeptides are familiar and routine techniques in the art.

Moreover, C35 polypeptides, including fragments, and specifically epitopes, can be combined with parts of the constant domain of immunoglobulins (IgG), resulting in chimeric polypeptides. These fusion proteins facilitate purification and show an increased halflife in vivo. One reported example describes chimeric proteins consisting of the first two domains of the human CD4polypeptide and various domains of the constant regions of the heavy or light chains of mammalian immunoglobulins. (EP A 394,827; Traunecker et al., *Nature* 331:8486 (1988).) Fusion proteins having disulfidelinked dimeric structures (due to the IgG) can also be more efficient in binding and neutralizing other molecules, than the monomeric secreted protein or protein fragment alone. (Fountoulakis et al., *J. Biochem.* 270:39583964 (1995).)

Similarly, EPAO 464 533 (Canadian counterpart 2045869) discloses fusion proteins comprising various portions of constant region of immunoglobulin molecules together with another human protein or part thereof. In many cases, the Fc part in a fusion protein is beneficial in therapy and diagnosis, and thus can result in, for example, improved pharmacokinetic properties. (EPA 0232 262.) Alternatively, deleting the Fc part after the fusion protein has been expressed, detected, and purified, would be desired. For example, the Fc portion may hinder therapy and diagnosis if the fusion protein is used as an antigen for immunizations. In drug discovery, for example, human proteins, such as hIL5, have been fused with Fc portions for the purpose of highthroughput screening assays to identify antagonists of hIL5. (See, D. Bennett et al., *J. Molecular Recognition* 8:5258 (1995); K. Johanson et al., *J. Biol. Chem.* 270:94599471 (1995).)

Moreover, the C35 polypeptides can be fused to marker sequences, such as a peptide which facilitates purification of C35. In preferred embodiments, the marker amino acid sequence is a hexahistidine peptide, such as the tag provided in a pQE vector (QIAGEN, Inc., 9259 Eton Avenue, Chatsworth, Calif., 91311), among others, many of which are commercially available. As described in Gentz et al., *Proc. Natl. Acad. Sci. USA* 86:821824 (1989), for instance, hexahistidine provides for convenient purification of the fusion protein. Another peptide tag useful for purification, the "HA" tag, corresponds to an epitope derived from the influenza hemagglutinin protein. (Wilson et al., *Cell* 37:767 (1984).)

Thus, any of these above fusions can be engineered using the C35 polynucleotides or the C35 polypeptides.

Vectors, Host Cells, and Protein Production

The present invention also relates to vectors containing the C35 polynucleotide, host cells, and the production of C35 polypeptides by recombinant techniques. The vector may be, for example, a phage, plasmid, viral, or retroviral vector. Retroviral vectors may be replication competent or replication defective. In the latter case, viral propagation generally will occur only in complementing host cells.

C35 polynucleotides may be joined to a vector containing a selectable marker for propagation in a host. Generally, a plasmid vector is introduced in a precipitate, such as a calcium phosphate precipitate, or in a complex with a charged lipid. If the vector is a virus, it may be packaged in vitro using an appropriate packaging cell line and then transduced into host cells.

The C35 polynucleotide insert should be operatively linked to an appropriate promoter, such as the phage lambda PL promoter, the *E. coli* lac, trp, phoA and tac promoters, the SV40 early and late promoters and promoters of retroviral LTRs, to name a few. Other suitable promoters will be known to the skilled artisan. The expression constructs will further contain sites for transcription initiation, termination, and, in the transcribed region, a ribosome binding site for translation. The coding portion of the transcripts expressed by the constructs will preferably include a translation initiating codon at the beginning and a termination codon (UAA, UGA or UAG) appropriately positioned at the end of the polypeptide to be translated.

As indicated, the expression vectors will preferably include at least one selectable marker. Such markers include dihydrofolate reductase, G418 or neomycin resistance for eukaryotic cell culture and tetracycline, kanamycin or ampicillin resistance genes for culturing in *E. coli* and other bacteria. Representative examples of appropriate hosts include, but are not limited to, bacterial cells, such as *E. coli, Streptomyces* and *Salmonella typhimurium* cells; fungal cells, such as yeast cells; insect cells such as *Drosophila* S2 and *Spodoptera* Sf9 cells; animal cells such as CHO, COS, 293, and Bowes melanoma cells; and plant cells. Appropriate culture mediums and conditions for the abovedescribed host cells are known in the art.

Among vectors preferred for use in bacteria include pHE-4 (and variants thereof); pQE70, pQE60 and pQE9, available from QIAGEN, Inc.; pBluescript vectors, Phagescript vectors, pNH8A, pNH16a, pNH18A, pNH46A, available from Stratagene Cloning Systems, Inc.; and ptrc99a, pKK2233, pKK2333, pDR540, pRIT5 available from Pharmacia Biotech, Inc. Among preferred eukaryotic vectors are pWLNEO, pSV2CAT, pOG44, pXT1 and pSG available from Stratagene; and pSVK3, pBPV, pMSG and pSVL available from Pharmacia. Other suitable vectors will be readily apparent to the skilled artisan. Preferred vectors are poxvirus vectors, particularly vaccinia virus vectors such as those described in U.S. patent application Ser. No. 08/935,377, the entire contents of which are incorporated herein by reference.

Introduction of the construct into the host cell can be effected by calcium phosphate transfection, DEAEdextran mediated transfection, cationic lipidmediated transfection, electroporation, transduction, infection, or other methods. Such methods are described in many standard laboratory manuals, such as Davis et al., *Basic Methods In Molecular Biology* (1986).

C35 polypeptides can be recovered and purified from recombinant cell cultures by wellknown methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Most preferably, high performance liquid chromatography ("HPLC") is employed for purification.

C35 polypeptides can also be recovered from: products purified from natural sources, including bodily fluids, tissues and cells, whether directly isolated or cultured; products of chemical synthetic procedures; and products produced by recombinant techniques from a prokaryotic or eukaryotic host, including, for example, bacterial, yeast, higher plant, insect, and mammalian cells. Depending upon the host employed in a recombinant production procedure, the C35 polypeptides may be glycosylated or may be nonglycosylated. In addition, C35 polypeptides may also include an initial modified methionine residue, in some cases as a result of hostmediated processes. Thus, it is well known in the art that the Nterminal methionine encoded by the translation initiation codon generally is removed with high efficiency from any protein after translation in all eukaryotic cells. While the Nterminal methionine on most proteins also is efficiently removed in most prokaryotes, for some proteins, this prokaryotic removal process is inefficient, depending on the nature of the amino acid to which the Nterminal methionine is covalently linked.

In addition to encompassing host cells containing the vector constructs discussed herein, the invention also encompasses primary, secondary, and immortalized host cells of vertebrate origin, particularly mammalian origin, that have been engineered to delete or replace endogenous genetic material (e.g. C35 coding sequence), and/or to include genetic material (e.g., heterologous polynucleotide sequences) that is operably associated with C35 polynucleotides of the invention, and which activates, alters, and/or amplifies endogenous C35 polynucleotides. For example, techniques known in the art may be used to operably associate heterologous control regions (e.g., promoter and/or enhancer) and endogenous C35 polynucleotide sequences via homologous recombination (see, e.g., U.S. Pat. No. 5,641,670, issued Jun. 24, 1997; International Publication No. WO 96/29411, published Sep. 26, 1996; International Publication No. WO 94/12650, published Aug. 4, 1994; Koller et al., *Proc. Natl. Acad. Sci. USA* 86:8932-8935 (1989); and Zijlstra et al., *Nature* 342:435-438 (1989), the disclosures of each of which are incorporated by reference in their entireties).

Having generally described the invention, the same will be more readily understood by reference to the following examples, which are provided by way of illustration and are not intended as limiting.

EXAMPLES

Example 1

Differential Expression of C35 in Human Breast Carcinoma

The present inventors have characterized a full-length cDNA representing a gene, C35, that is differentially expressed in human breast and bladder cancer (FIG. 1A). A 348 base pair DNA fragment of C35 was initially isolated by subtractive hybridization of poly-A RNA from tumor and normal mammary epithelial cell lines derived from the same patient with primary infiltrating intraductal mammary carcinoma. (Band, V. et al., *Cancer Res.* 50:7351-7357 (1990). Employing primers based on this sequence and that of an overlapping EST sequence (Accession No. W57569), a cDNA that includes the full-length C35 coding sequence was then amplified and cloned from the SKBR3 breast tumor cell line (ATCC, HTB-19). This C35 cDNA includes, in addition to the 348 bp coding sequence, 167 bp of 3' untranslated region.

Figure 2A:
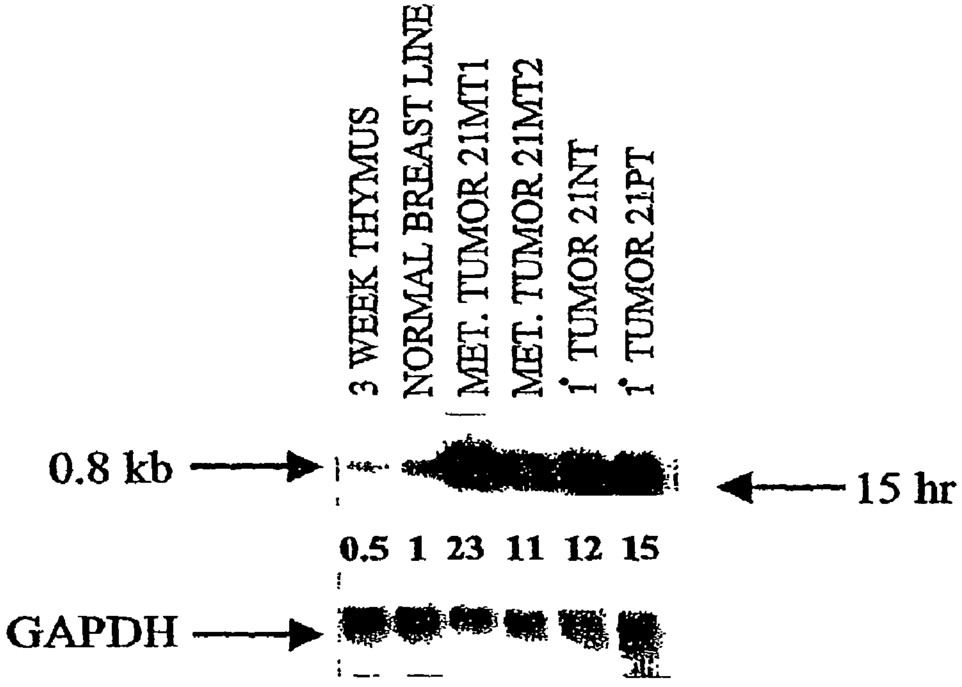
FIGS. 2A-2C.
Figure 2B:
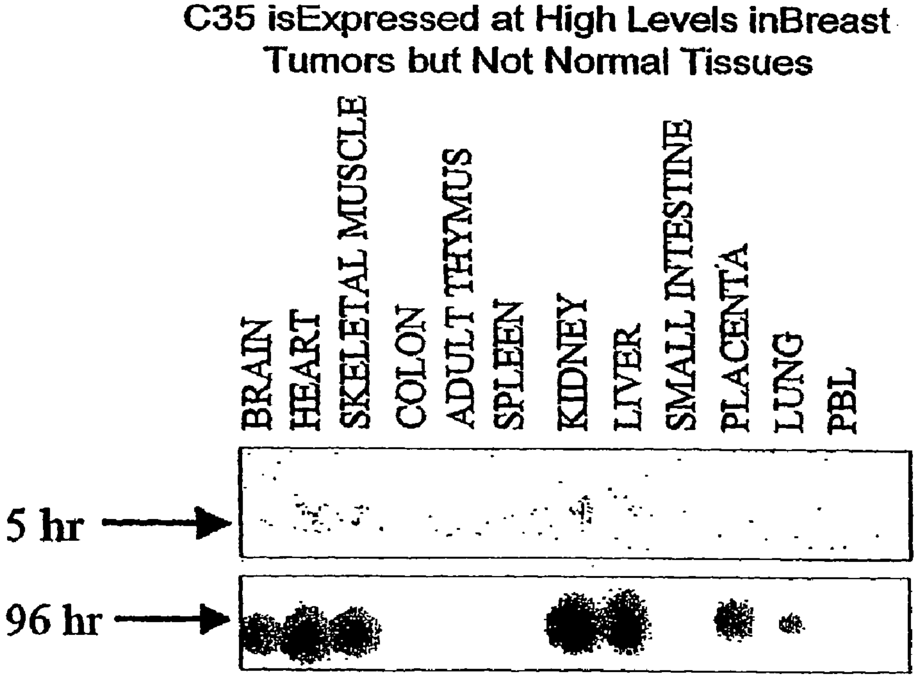
Figure 2C:
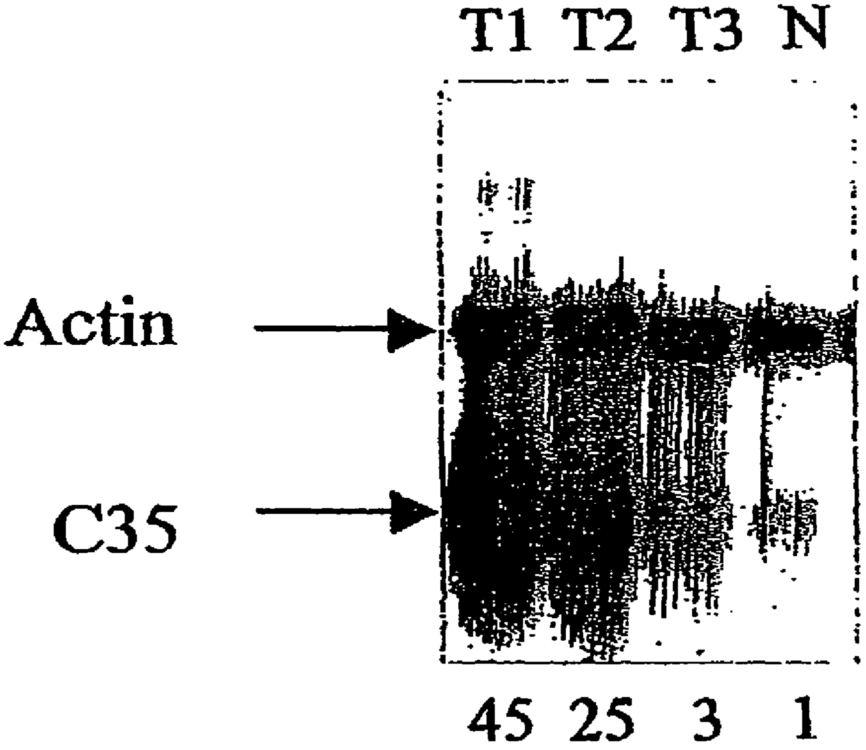
Figure 3:
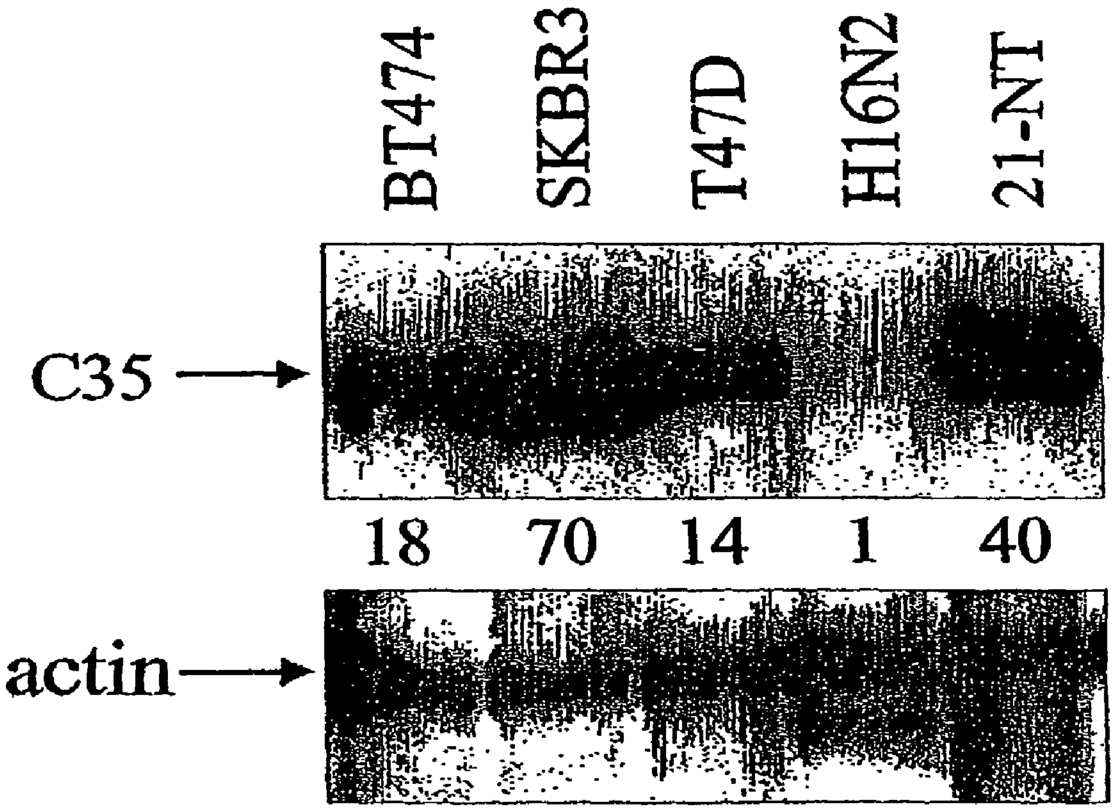
FIG. 3. Expression of C35 in Breast Tumor Cell Lines. C35 is overexpressed in different breast tumor cell lines. Upper Panel: 300 ng of poly-A RNA from BT474 (ATCC HYB-20, mammary ductal carcinoma), SKBR3 (ATCC HTB-30, mammary adenocarcinoma), T47D (ATCC HTB-133, mammary ductal carcinoma), normal breast epithelial cell line H16N2 from patient 21, and 21-NT breast tumor cell line derived from primary tumor nodule of the same patient 21 was resolved on a 1% agarose/formaldehyde gel and transferred to a GENESCREEN™ membrane. This blot was hybridized with a $^{32}P$ labeled C35 probe. Hybridization was detected by exposing the blot to film for 15 hours. Lower Panel: To quantitate RNA loading, the same blot was stripped and re-hybridized with a $^{32}P$ labeled probe for beta-actin. For each sample the C35 signal was normalized to the actin signal. The numbers represent the fold expression of C35 in each sample relative to H16N2.

Differential expression of the C35 sequence is demonstrated in FIG. 2A which compares expression levels of clone C35 in poly-A RNA from cell lines derived from normal mammary epithelium, from two primary breast tumor nodules, and from two metastatic lung tumor nodules isolated approximately one year later from the same patient (Band, V. et al., *Cancer Res.* 50:7351-7357 (1990)). Quantitative analysis indicates that the sequence is expressed at a more than 10 fold higher level in tumor cells than in normal mammary epithelium. Low expression levels in a panel of other normal tissues is demonstrated by the Northern hybridization results of FIG. 2B. Even though three times as much poly-A RNA was loaded from normal tissues as from the tumor cell lines, little or no expression of RNA homologous to C35 was detected after a comparable 15 hour exposure. Only after an extended 96 hour exposure was low level expression of some homologous sequences detected in normal spleen and kidney tissues. Analysis of expression of C35 homologous sequences in poly-A RNA from three primary infiltrating ductal breast carcinoma from different patients as well as a sample of normal breast epithelium is shown in FIG. 2C. In comparison to normal breast epithelium, sequences homologous to C35 are overexpressed as much as 45 and 25 fold in two of the three primary breast tumors.

The present inventors previously conducted an analysis of an immunoprotective tumor antigen expressed in several independently derived murine tumors and, at much reduced levels, in normal mouse tissues. (See U.S. patent application filed Mar. 28, 2000, titled "Methods of Producing a Library and Methods of Directly Selecting Cells Expressing Inserts of Interest," the entire contents of which are hereby incorporated herein by reference). In this case, a factor of 9 difference between expression levels in tumor and normal tissues was associated with induction of an immunoprotective tumorspecific response. As discussed above, the expression level of C35 in some human breast cancers relative to normal tissue exceeds a factor of 9, suggesting that C35 might also be immunoprotective against breast cancer in these individuals.

Example 2

C35 Specific CTL are Cytolytic for C35 Positive Breast Tumor Cells

Although a gene product may be overexpressed in tumor cells, as is the case for C35, it is immunologically relevant only if peptides derived from that gene product can be processed and presented in association with MHC molecules of the tumor cells. It is conceivable that for any given gene product either no peptides are produced during the cellular degradation process that satisfy the requirements for binding to the MHC molecules expressed by that tumor, or, even if such peptides are generated, that defects in transport or competition for MHC molecules by other tumor peptides would preclude presentation of any peptides from that specific gene product. Even if relevant tumor peptides are processed and presented in association with human MHC in the tumor cells, it must in all cases be determined whether human T cells reactive to these peptides are well represented in the repertoire or whether T cells may have been rendered tolerant, perhaps due to expression of the same or a related antigen in some other nonhomologous normal tissue. For both these reasons, therefore, it is essential to confirm that MHCrestricted, human tumor antigenspecific T cells can be induced by C35 and that they are indeed crossreactive on human tumor cells. Relevant information on this point can be obtained through in vitro stimulation of human T cell responses with recombinant C35 or C35 peptides presented by autologous antigen presenting cells.

A major technical problem in evaluating T cell responses to recombinant gene products is that a strong immune response against the expression vector can block or obscure the recombinant specific response. This is particularly a problem with primary responses that may require multiple cycles of in vitro stimulation. To minimize vector specific responses, it is possible to alternate stimulation by antigen presenting cells infected with different viral vectors recombinant for the same gene product. Convenient vectors include: retroviruses, adenovirus, and pox viruses.

Human PBMC were purified using Ficoll-Hypaque and subjected to rosetting with neuraminidasetreated sheep erythrocytes to isolate monocytes (erythrocyte rosette negative, ER) and T lymphocytes ($ER^+$). Dendritic cells were generated from the ER fraction by culture for 7 days in rhGMCSF (1000 U/ml) and rhIL4 (1000 U/ml) with fresh medium and cytokines being added every other day. At day 7, immature dendritic cells were transduced with retrovirus expressing human C35 in the presence of polybrene (1 ug/ml) for 6 hours. Cells were washed and incubated under maturation conditions for 4 days in the presence of 12.5% monocyte conditioned medium, 1000 U/ml rhGMCSF and 1000 rhU/ml IL4 and 1% autologous serum. At this point, the dendritic cells were incubated with autologous T lymphocytes (cryopreserved $ER^+$ fraction) at a ratio of 1 DC:50 T cells for 14 days. Viable T cells were restimulated with autologous, irradiated EBVB B cells infected at a multiplicity of infection of 1 overnight (16 hours) with a vaccinia recombinant expressing human C35 in the presence of cytokines IL2 (20 U/ml), IL12 (20 U/ml) and IL18 (10 ng/ml). Cells were restimulated two more times with autologous EBVB cells infected with C35bearing retrovirus in the presence of IL2 and IL7 (10 ng/ml). Cytotoxic activity was measured after a total of 4 stimulations by $^{51}Cr$ release assay using 5000 targets/well in a 4 hour assay. The results shown in Table 8 below demonstrate specific cytotoxic activity of C35 stimulated T cells against 21NT breast tumor cells that express relatively elevated levels of C35 but not against MDAMB231 tumor cells that express the same low levels of C35 as normal nontransformed epithelial cells.

TABLE 8

C35 specific CTL are Cytolytic for C35 Positive Breast Tumor Cells

| Target Cells Autologous | HLA HaployPe (Effectors: A2, A11; B8, B35) | E:T 20:1 (% specific lysis) | E:T 10:1 (% specific lysis) |
|---|---|---|---|
| EBVB | A2, A11; B8, B35 | 2 | 1 |
| MDAMB231 C35 low (1x) | A2; B8 | 3 | 1 |
| 21NT C35 high (12x) | A26, A31; B35, B38 | 22 | 10 |
| K562 | | 2 | 0 |

Example 3

C35 Expression on the Membrane of Breast Carcinoma Cells

To determine whether the C35 polypeptide product is expressed on the surface of tumor cells, a C35 specific antiserum was prepared. BALB/c mice were immunized with syngeneic Line 1 mouse tumor cells that had been transduced with retrovirus encoding human C35. Mice were bled following a series of two or more immunizations. The immune sera were employed to detect surface expression of C35 protein by flow cytometry on three breast tumor cell lines representing high (21NT), intermediate (SKBR3), and low (MDA-MB-231 levels of expression of the C35 transcript in Northern blots (see FIGS. 4A-4C). $1\times10^5$ breast tumor cells were stained with 3.5 microliters of C35 specific antiserum or control, pre-bleed BALB/c serum. After a 30 minute incubation, cells were washed twice with staining buffer (PAB) and incubated with FITC-goat anti-mouse IgG (1 ug/sample) for 30 minutes. Samples were washed and analyzed on an EPICS ELITE™ flow cytometer. The results presented in FIGS. 4A-4C demonstrate membrane expression of the C35 antigen recognized by the specific immune serum at high levels on tumor line 21NT (FIG. 4A), intermediate levels for tumor line SKBR3 (FIG. 4B), and undetectable levels in tumor line MDA-MB-231 (FIG. 4C). The high level of reactivity of antibody to membranes of tumor cells that express elevated levels of C35 transcripts suggests that C35 specific antibodies may serve as effective immunotherapeutic agents for the large number of breast carcinoma that overexpress this gene product (see FIGS. 2A-2C and 3).

Example 4

A Deregulated Ribosomal Protein L3 Gene Encodes a Shared Murine Tumor Rejection Antigen The present inventors have developed novel antigen discovery technology that allows for the selection of genes encoding CTL epitopes from a cDNA library constructed in a poxvirus. Using this technology the present inventors have determined that a shared murine tumor antigen is encoded by an alternate allele of the ribosomal protein L3 gene. The immunogenic L3 gene is expressed at significant albeit reduced levels in normal tissues including thymus. Immunization with a vaccinia recombinant of the immunogenic L3 cDNA induces protective immunity against tumor challenge. It is of particular interest that a deregulated allele of a housekeeping gene can serve as an immunoprotective antigen and that thymic expression does not preclude immunogenicity of an upregulated tumor product. These observations emphasize that tolerance to a self-protein is not absolute but must be defined in relation to quantitative levels of expression. The ribosomal protein described may be representative of a class of shared tumor antigens that arise as a result of deregulated expression of a self-protein without compromising immune tolerance to normal tissues. Such antigens would be suitable for immunotherapy of cancer in vital organs.

Methods

Total RNA was isolated from BCA 39 tumor cells using the PERFECT RNA™ Total RNA Isolation Kit (5 Prime 3 Prime, Inc., Boulder, Colo.). Poly A+ mRNA was isolated from the total RNA using DYNABEADS™ (Dynal, Lake Success, N.Y.). Two micrograms of poly A+ mRNA was converted to double stranded cDNA using the GREAT LENGTHS cDNA SYNTHESIS KIT™ (Clontech, Palo Alto, Calif.). The double stranded cDNA was then inserted in vaccinia virus vector v7.5/tk.

Balb/cByJ (Jackson Labs) mice were immunized intraperitoneally with $2\times10^6$ irradiated (6,500 cGy) BCA 34 cells. Two weeks later the mice were boosted by subcutaneous injection of $2\times10^6$ irradiated BCA 34 cells. One week following the second immunization splenocytes were harvested, divided into 12 parts and cultured in 12 well plates with $6\times10^5$ irradiated (10,000 cGy), mitomycin C treated BCA 34 cells per well. At weekly intervals viable T cells were purified using Lympholyte-M (Accurate Chemical, Westbury, N.Y.) and cultured in 12 well plates at $1.5\times10^6$ T cells per well. To each well was also added $4\times10^6$ irradiated (5000 cGy) Balb/c spleen, along with $6\times10^5$ irradiated, mitomycin C treated BCA 34 cells.

A specific vaccinia recombinant that encodes the well characterized ovalbumin 257-264 peptide (SIINFEKL (SEQ ID NO:2122)) that is immunodominant in association with H-2K$^b$ was diluted with nonrecombinant virus so that it initially constituted either 0.2%, 0.01%, or 0.001% of total viral pfu. An adherent monolayer of MC57G cells (H 2$^b$) were infected with this viral mix at m.o.i.=1 (approximately $5\times10^5$ cells/well). Following 12 hours infection, ovalbumin peptidespecific CTL, derived by repeated in vitro stimulation of ovalbumin primed splenic T cells with the immunodominant SIINFEKL (SEQ ID NO:2122) peptide, were added. During this incubation those adherent cells which were infected with a recombinant particle that expresses the ovalbumin peptide are targeted by specific cytotoxic T cells and undergo a lytic event which causes them to be released from the monolayer. Following incubation with CTL, the monolayer is gently washed, and both floating cells and the remaining adherent cells are separately harvested. Virus extracted from each cell population was titred for the frequency of recombinant (BRdU resistant) viral pfu. Virus extracted from floating cells was then used as input to another enrichment cycle with fresh adherent MC57G cells and ovalbumin peptide-specific CTL. It was observed that following enrichment of VVova to greater than 10% of total virus, further enrichment of the recombinant virus was accelerated if the m.o.i. in succeeding cycles was reduced from 1 to 0.1.

Confluent monolayers of BCN in wells of a 12 well plate were infected with moi=1.0 vaccinia BCA39 cDNA library. At 12 hours post-infection the monolayers were washed 3× with media, and $2.5\times10^6$ CTL were added to the wells in a 250 μl volume. The T cells and targets were incubated at 37° C. for 4 hours. Following the incubation the supernatant was harvested, and the monolayer gently washed 3× with 250 μl media. Virus was released from the cells by freeze/thaw, and titers determined by plaque assay on BSC1 cells. The selected virus population (floating cells in cultures that received specific T cells) was amplified on BSC1 cells in one well of a 12 well plate for 2 days. The virus was then harvested and titered. This viral stock was subjected to three additional enrichment cycles. The selected virus population was not amplified prior to the next cycle.

Virus from the fourth enrichment cycle was divided into 40 pools of 5 pfu each. Each pool was amplified on BSC1 cells in a 96 well plate, with 1 pool/well. After 4 days the virus was harvested (P1), and used to infect monolayers of BCN in a 96 well plate at moi=5, with 1 pool per well. As a control, a monolayer of BCN was infected with moi=5 vNotI/tk (Merschlinsky et al., *Virology* 190:522 (1992)). At 5 hours post-infection, $2\times10^4$ washed CTL were added to each well. The final volume in each well was 225 μl. The cells were incubated at 37° C. for 18 hours. The cells were then pelleted by centrifugation, 150 μl supernatant was harvested and tested for IFNg by ELISA. Twenty seven of the forty pools of 5 pfu were positive for the ability to stimulate CTL. Suggesting, by Poisson analysis, that specific recombinants were enriched to greater than 20%. Individual clones were picked from 5 positive pools and assayed as above.

Monolayers of B/C.N in a 6 well plate were infected with moi=1.0 of v7.5/tk, vF5.8, or vH2.16. At 14 hours post-infection cells were harvested along with the control targets: B/C.N, BCA 34, and BCA 39. The target cells were labeled with 100 microcuries $^{51}$Chromium (Dupont, Boston, Mass.) for 1 hour at 37° C., and $10^4$ cells were added to wells of a 96 well round bottom plate in quadruplicate. Tumor specific CTL were added to target cells at the indicated ratios. Cells were incubated at 37° C. for 4 hours. Supernatants were harvested and $^{51}$Cr release determined. Spontaneous release was derived by incubating target cells with media alone. Maximal release was determined by incubating target cells with 5% Triton X 100. Percentage of specific lysis was calculated using the formula: % specific lysis=((experimental release−spontaneous release)/(maximal release−spontaneous release))×100. In each case the mean of quadruplicate wells was used in the above formula.

Two micrograms of total RNA was converted to cDNA using a dT primer and SUPERSCRIPT™ II Reverse Transcriptase (BRL, Gaithersburg, Md.). cDNA was used as the template for a PCR using L3 specific primers; L3.F1.S (CGGCGAGATGTCTCACAGGA SEQ ID NO:2124)) and L3.F1.AS (ACCCCACCATCTGCACAAAG (SEQ ID NO:2125)); and KLENTAQ™ DNA Polymerase Mix (Clontech) in a 20 microliter final volume. Reaction conditions included an initial denaturation step of 94° C. for 3 minutes, followed by 30 cycles of: 94° C. 30 seconds, 60° C. for 30 seconds, 68° C. for 2 minutes. These PCR products contained the region of L3 between position 3 and 1252. The PCR products were purified using CENTRICON™ 100 columns (Amicon, Beverly, Mass.), digested with Sau3AI, and resolved on a 3% Agarose/ethidium bromide gel.

Adult female Balb/cByJ mice (2 mice per group) were immunized by subcutaneous injection of $5\times10^6$ pfu of vH2.16, or v7.5/tk. Seven days following the immunization splenocytes were harvested and cultured in 12 well plates along with 1 micromolar peptide $L3_{48-56}$(I54). After seven days the viable T cells were purified using Lympholyte-M, and $1\times10^6$ T cells were added to wells of a 12 well plate along with 1 micromolar peptide and $4\times10^6$ irradiated (5000 cGy) Balb/c spleen cells per well.

Adult female Balb/cByJ mice were immunized by subcutaneous injection of $10\times10^6$ pfu of vH2.16, vPKIa, v7.5/tk or Phosphate Buffered Saline. Secondary immunizations were given 21 days later. Mice were challenged with tumor by subcutaneous injection of $2\times10^5$ BCA 34 cells twenty one (primary immunization only) or fourteen days following immunization.

Results and Discussion

Prospects for development of broadly effective tumor vaccines have been advanced by evidence that several self-proteins can be recognized as tumor antigens by immune T cells (Van den Eynde et al., *J. Exp. Med.* 173:1373 (1991); M. B. Bloom et al., *J. Exp. Med.* 185:453 (1997); Van Der Bruggen et al., *Science* 254:1643 (1991); Gaugler et al., *J. Exp. Med.* 179:921 (1994); Boel et al., *Immunity* 2:167 (1995); Van Den Eynde et al., *J. Exp. Med.* 182:689 (1995); Kawakami et al., *Proc. Natl. Acad. Sci. U.S.A.* 91:3515 (1994); Kawakami et al., *Proc. Natl. Acad. Sci. U.S.A.* 91:6458 (1994); Brichard et al., *J. Exp. Med.* 178:489 (1993)). Such normal, nonmutated gene products may serve as common target antigens in tumors of certain types arising in different individuals. Clinical evidence for induction of protective immunity following vaccination with such shared tumor antigens is, currently, very limited (Marchand et al., *Int. J. Cancer* 80:219 (1999); Rosenberg et al., *Nat. Med.* 4:321 (1998); Overwijk et al., *Proc. Natl. Acad. Sci.* 96:2982 (1999); Brandle et al., *Eur. J. Immunol.* 28:4010 (1998)). It is, moreover, not at all clear whether the T cell responses to these self-proteins represent a surprising breakdown in immunological tolerance or are a consequence of qualitative or quantitative changes in the expression of the self-proteins in tumor cells. In the latter case, normal tissue tolerance could be maintained and vaccine induced immunity to self-proteins whose expression is systematically altered in tumors might be applicable even to cancer of vital organs.

The present inventors have shown that a ribosomal protein allele that is systematically deregulated in multiple murine tumors during the transformation process is a tumor rejection antigen and that the principal correlate of immunogenicity is a dramatic change in quantitative expression in tumors relative to normal tissues and thymus.

Previously, the present inventors have reported that cross-protective immunity is induced among three independently derived murine tumor cell lines (Sahasrabudhe et al., *J. Immunology* 151:6302 (1993)). These tumors, BCA 22, BCA 34, and BCA 39 were derived by in vitro mutagenesis of independent subcultures of the B/C.N line, a cloned, immortalized, anchorage-dependent, contact inhibited, nontumorigenic fibroblast cell line derived from a Balb/c embryo (Collins et al., *Nature* 299:169 (1982); Lin et al., *JNCI* 74:1025 (1985)). Strikingly, immunization with any of these tumor cell lines, but not with B/C.N provided protection against challenge with not only homologous tumor cells, but also against challenge with the heterologous tumor cell lines. Following immunization with any of these three tumor cell lines, CD8+ cytolytic T lymphocyte (CTL) lines and clones could be generated which in vitro displayed crossreactive specificity for the same three tumors, but not for the non-tumorigenic B/C.N cells from which they derived.

In order to move from an immunological definition to a molecular definition of this shared tumor antigen(s), the present inventors developed a novel and efficient method for the identification of genes that encode CTL target epitopes. In this approach a cDNA library from the BCA 39 tumor cell line was constructed in a modified vaccinia virus expression vector (Merchlinsky et al., *Virology* 238:444 (1997); E. Smith et al., Manuscript in preparation). Five hundred thousand plaque forming units (pfu) of this library were used to infect a monolayer of antigen-negative B/C.N cells at a multiplicity of infection (moi) of 1. Following 12 hours infection, BCA 34 tumor specific CTL were added to the target cell monolayer at an effector to target ratio that gives approximately 50% lysis in a standard $^{51}Cr$ release assay. CTL specific for the heterologous BCA 34 tumor cell line were used in order to facilitate the identification of antigen(s) which are shared between these two tumor cell lines. Since adherence is an energy dependent process, it was expected that cells that undergo a CTL mediated lytic event would come off of the monolayer and could be recovered in the supernatant. By harvesting virus from floating cells following cell mediated lymphocytotoxicity (CML), it was possible to enrich for viral recombinants that had sensitized the host cell to lysis. An essential feature of this procedure is that it lends itself to repetition. The virus harvested following one cycle of enrichment can be used as input for additional cycles of selection using fresh monolayers and fresh CTL until the desired level of enrichment has been achieved. In a model experiment with CTL specific for a known recombinant, it was possible to demonstrate that specific recombinants could be enriched from an initial dilution of 0.001% to approximately 20% in 6 cycles of selection (Table 9). At this level it is a simple matter to pick individual plaques for further characterization.

TABLE 9

Multiple Cycles of Enrichment for VVova

| | Enrichment | % VVova in Floating Cells | | |
|---|---|---|---|---|
| | Cycle # | Expt. 1 | Expt. 2 | Expt. 3 |
| moi = 1 | 0 | 0.2 | 0.01 | 0.001 |
| | 1 | 2.1 | 0.3 | nd |
| | 2 | 4.7 | 1.1 | nd |
| | 3 | 9.1 | 4.9 | nd |
| | 4 | 14.3 | 17.9 | 1.4 |
| | 5 | 24.6 | | 3.3 |
| | 6 | | | 18.6 |
| moi = 0.1 | 5 | 48.8 | 39.3 | |

Figure 5A:
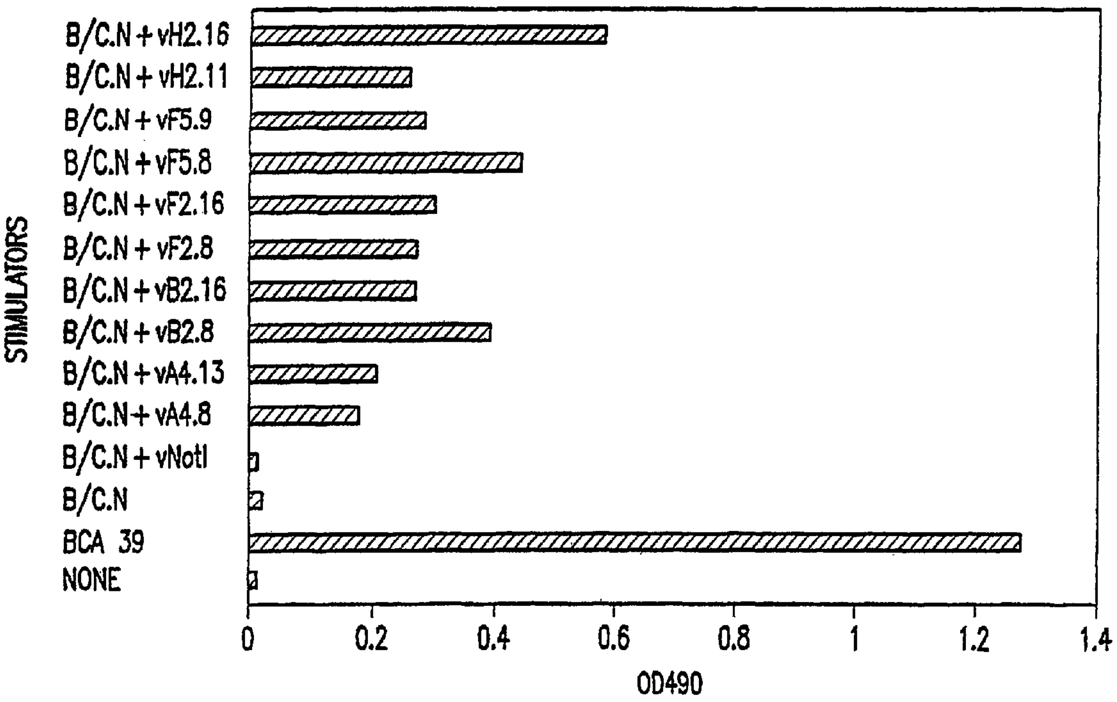

A vaccinia cocktail composed of wild type vNotI/tk (tk+) spiked with the indicated concentrations of VVova (tk−) was subjected to CML Selection (12)
% VVova = (Titer with BudR/Titer without BudR) × 100
nd = not determined The poxvirus expression library was subjected to 4 cycles of selection with tumor-specific CTL. Individual plaques of the selected viral recombinants were expanded and used to infect separate cultures of B/C.N cells. These cells were assayed for the ability to stimulate specific CTL to secrete interferon gamma (IFN-gamma) (FIG. 5A), or for sensitization to lysis by the tumor-specific CTL (FIG. 5B). Ten viral clones were isolated, all of which conferred upon B/C.N the ability to stimulate a line of tumor-specific CTL to secrete IFNγ. All 10 clones contained the same sized (1,300 bp) insert (Smith et al., unpublished data). Sequence analysis confirmed that clones F5.8 and H2.16 contained the same full-length cDNA. It appeared, therefore, that all ten clones were recombinant for the same cDNA. In all, 6 of 6 CTL lines that were generated by immunization with BCA 34 demonstrated specificity for this antigen.

A search of GenBank revealed that this cDNA is highly homologous to the murine ribosomal protein L3 gene (Peckham et al., *Genes and Development* 3:2062 (1989)). Sequencing the entire H2.16 clone revealed only a single nucleotide substitution that coded for an amino acid change when compared to the published L3 gene sequence. This C170T substitution generates a Threonine to Isoleucine substitution at amino acid position 54. The F5.8 clone also contained this nucleotide substitution.

Figure 7B:
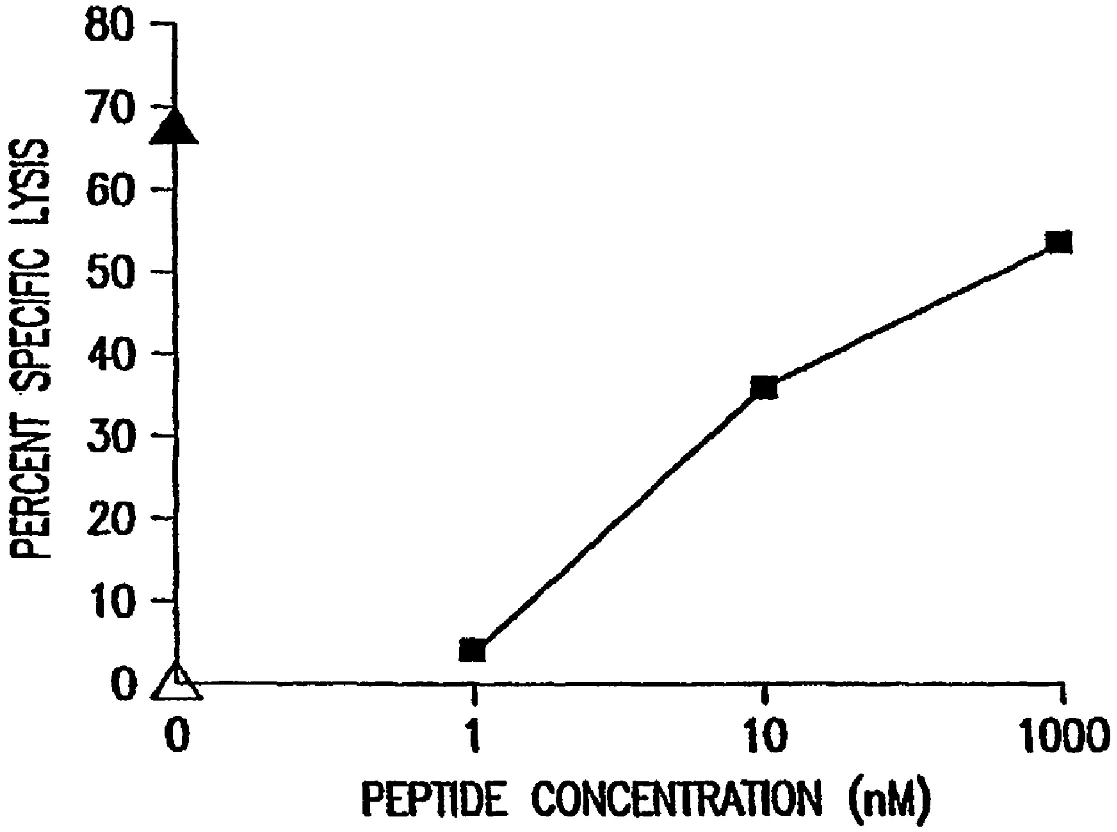
Figure 12:
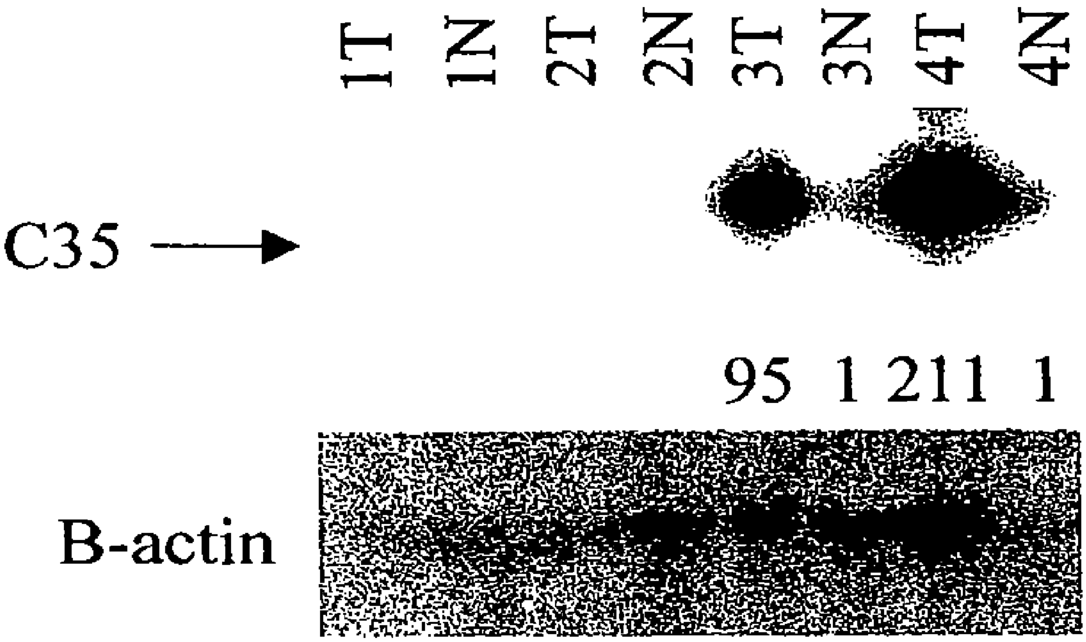
FIG. 12. C35 Expression in Bladder Carcinoma. C35 was labeled with $^{32}P$ in a random priming reaction and hybridized to a Northern blot of tumor and normal RNA at $10^6$ cpm/ml. The blot was stripped and re-probed with Beta-actin to normalize mRNA loads. The numbers indicate densitometry ratios normalized against Beta-actin. Values are relative to the level of expression in the normal bladder samples. 300 ng mRNA was electrophoresed on 0.8% alkaline agarose gels, then blotted to GENESCREEN PLUS™.

Since CTL recognize antigen as peptide presented by a Major Histocompatibility Complex (MHC) molecule, it was of interest to identify the peptide epitope recognized by these class I MHC-restricted tumor-specific CD8+ T cells. It was considered likely that the altered amino acid (Ile 54) would be included in the peptide recognized by the CTL. This hypothesis was supported by the demonstration that a vaccinia virus clone recombinant for only the first 199 bp (63 amino acids) of H2.16 ($vH2_{199}$) was able to sensitize B/C.N to lysis by tumor-specific CTL (Smith et al., unpublished data). A Computer screen of peptide-binding motifs suggested that there are two epitopes encoded within this region that could associate with high affinity to the class I MHC molecule Kd (FIG. 12) (Parker et al., *J. Immunology* 152:163 (1994)). These two peptides, $L3_{45-54}$ (I54) and $L3_{48-56}$ (I54) were synthesized and tested for the ability to sensitize B/C.N cells to lysis by tumor-specific CTL. As shown in FIG. 7A, peptide $L3_{48-56}$ (I54) sensitized B/C.N to lysis, while $L3_{45-54}$ (I54), and the wild type $L3_{48-56}$ (T54) did not. It was determined that 10 nM $L3_{48-56}$ (I54) was sufficient to sensitize targets to lysis by CTL, whereas 100 mM $L3_{48-56}$ (T54) did not (FIG. 7B). These results demonstrate that peptide $L3_{48-56}$ (I54) is a target epitope recognized by the tumor-specific CTL.

To analyze expression of the different L3 gene products, oligo-dT primed cDNA was synthesized from RNA of tumors and the B/C.N cell line from which they derived. The first strand cDNA was subjected to PCR amplification using a pair of primers which amplify nearly the entire mouse L3 mRNA. Sequence analysis of these PCR products showed that B/C.N and BCB13 L3 cDNA contained a C at position 170 (same as published sequence). BCB13 is a tumor cell line that was derived from the B/C.N cell line, but that is not immunologically cross-protective with the BCA tumor cell lines (Sahasrabudhe et al., *J. Immunology* 151:6302 (1993)). Sequence analysis of the PCR products from the crossreactive BCA 39, BCA 34, and BCA 22 tumors suggested that these cell lines express two different species of L3 mRNA. One species contains a C at 170, and the other contains a T at 170, as in the H2.16 clone. The sequence of all L3 cDNAs were identical except for this one base substitution.

There are two possible ways to account for the origin of the new L3 RNA in tumor cells. Either the L3 (C170T) gene expressed in these tumors is a somatic mutant of the wild type gene or there are multiple germ line alleles of L3, at least one of which gives rise to an immunogenic product when deregulated during the process of tumor transformation. We considered the first hypothesis unlikely because the crossreactive BCA 39, BCA 34, and BCA 22 tumors were independently derived. It would be remarkable if the same mutant epitope was generated in all three tumors. On the other hand, Southern blots of different restriction digests of genomic DNA from BCA 39 and B/C.N suggested that there are multiple copies of the L3 gene in the mouse genome (Smith et al., unpublished data). The L3 gene has also been reported to be multi-allelic in both the rat and the cow (Kuwano et al., *Biochemical and Biophysical Research Communications* 187:58 (1992); Simonic et al., *Biochemica et Biophysica Acta* 1219:706 (1994)). Further analysis was required to test the hypothesis that different L3 alleles in the germ line are subject to differential regulation in tumors and normal cells.

Figure 8A:
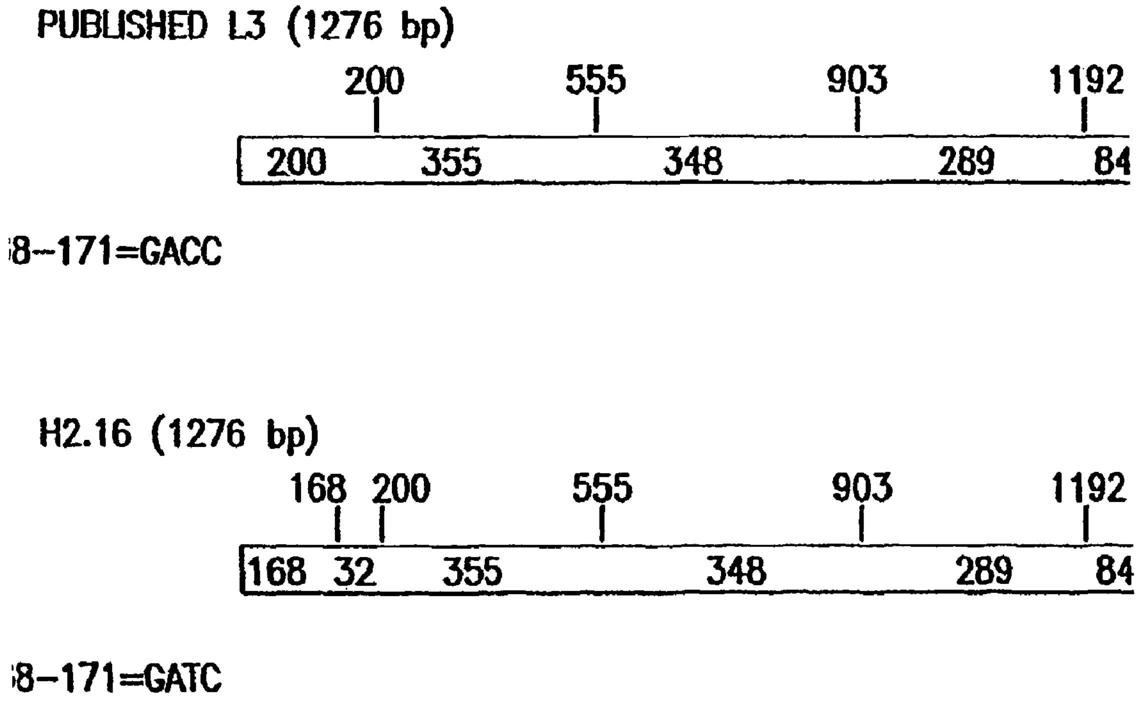
FIGS. 8A to 8C. Analysis of L3 Expressed by Each Cell Line.
Figure 8B:
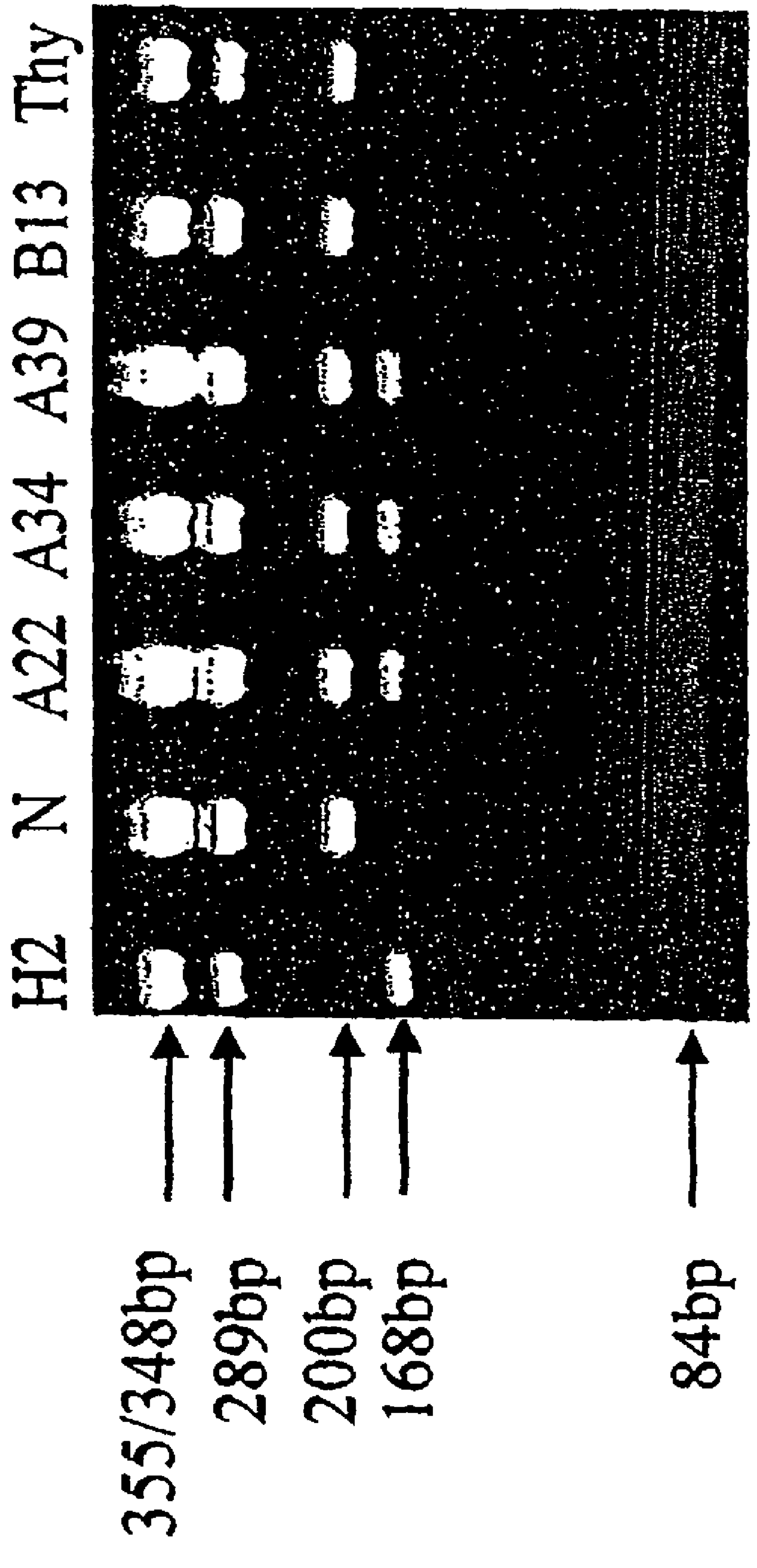
Figure 8C:
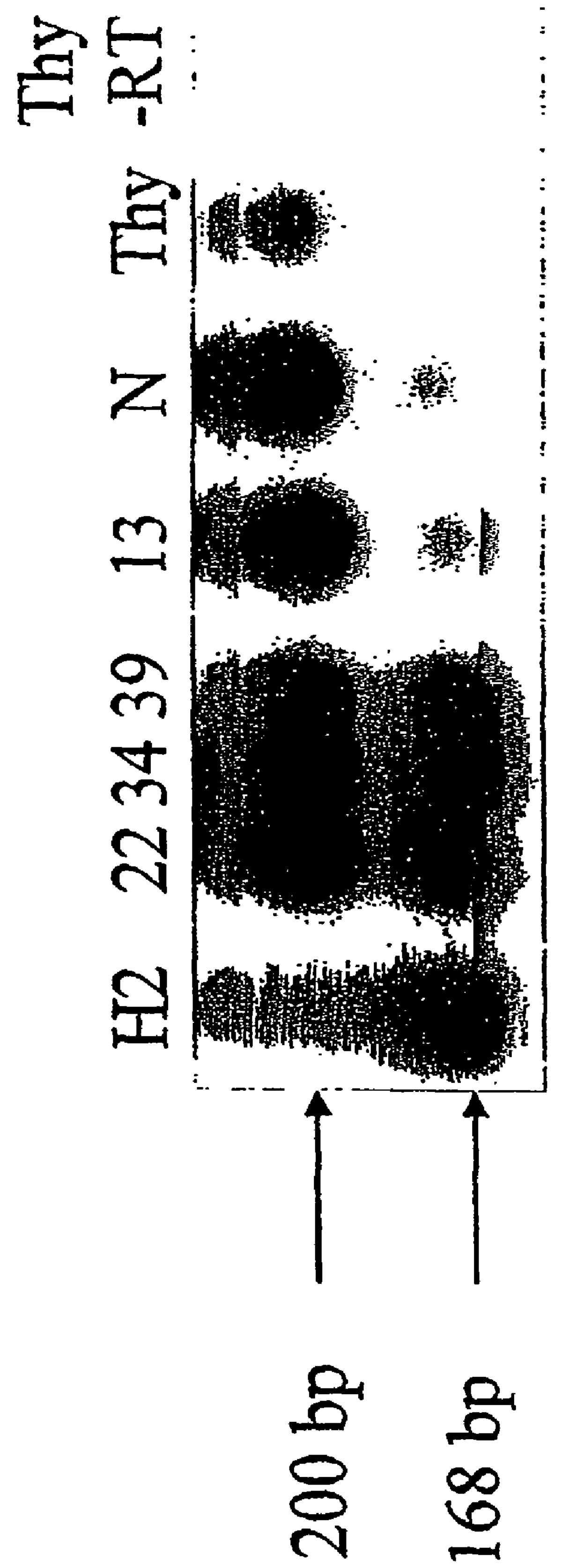

The nucleotide sequence of the published L3 from position 168 to 171 is GACC. The sequence of H2.16 in this same region is GATC (FIG. 8A). This new palindrome is the recognition sequence for a number of restriction endonucleases, including Sau3AI. As shown in the restriction map of FIG. 8A, a Sau3A I digest of L3 is expected to generate fragments of 200, 355, 348, 289, and 84 base pairs, while a Sau 3A I digest of H2.16 would generate a 168 bp fragment in place of the 200 bp fragment. This difference in the Sau 3AI digestion products was used to confirm that the three BCA cell lines express at least two different L3 alleles. The L3 RT-PCR products from all 5 cell lines and thymus RNA were digested with Sau 3AI and analyzed on an agarose gel. As shown in FIG. 8B all 3 BCA lines express both versions of L3. Remarkably, when this assay was repeated using greater amounts of starting material, the 168 bp fragment was also detectable in the digests of B/C.N, BCB13 and normal thymus cDNA (Smith et al., unpublished data). To enhance the sensitivity of this assay, the PCR was repeated using a $P^{32}$ end-labeled 5' L3 specific primer. The radiolabeled PCR products were digested with Sau3AI and resolved on an agarose gel. As shown in FIG. 8C, B/C.N, BCB13 and thymus contain the 168 bp fragment. Quantitative analysis indicates that the ratio of 200 bp:168 bp fragments in the BCA tumors is 2:1 while the ratio of the same fragments detected in B/C.N, BCB13, and thymus is approximately 20:1. Low levels of expression of this immunogenic L3 allele was also observed when RNA from kidney, heart, and skeletal muscle was analyzed (Smith et al., unpublished data). These results suggest that gene deregulation associated with the transformation process in the crossreactive tumors leads to the expression of higher levels of this germ line L3 (C170T) allele, and that this altered L3 gene was not generated by somatic mutation of the L3 gene that is predominantly expressed in normal tissues. The present inventors have termed this new L3 allele (C170T), the immunogenic L3 allele (iL3).

It is particularly intriguing that the immunogenic L3 allele is also expressed, albeit at a 10 fold reduced level, in normal thymus. This level of expression is evidently not sufficient to tolerize all T cells with functional avidity for the level of deregulated iL3 expressed in some tumors. The observation that although B/C.N and BCB13 express low levels of iL3, they are not susceptible to lysis by the tumor specific CTL suggests, however, that higher affinity T cells have been tolerized. This appears to be the first instance in which a tumor antigen has been reported to be expressed in the thymus. These observations emphasize that tolerance to a self-protein is not absolute but must be defined in relation to quantitative levels of expression (Targoni et al., *J. Exp. Med.* 187:2055 (1998); C. J. Harrington et al., *Immunity* 8:571 (1998)).

Figure 9B:
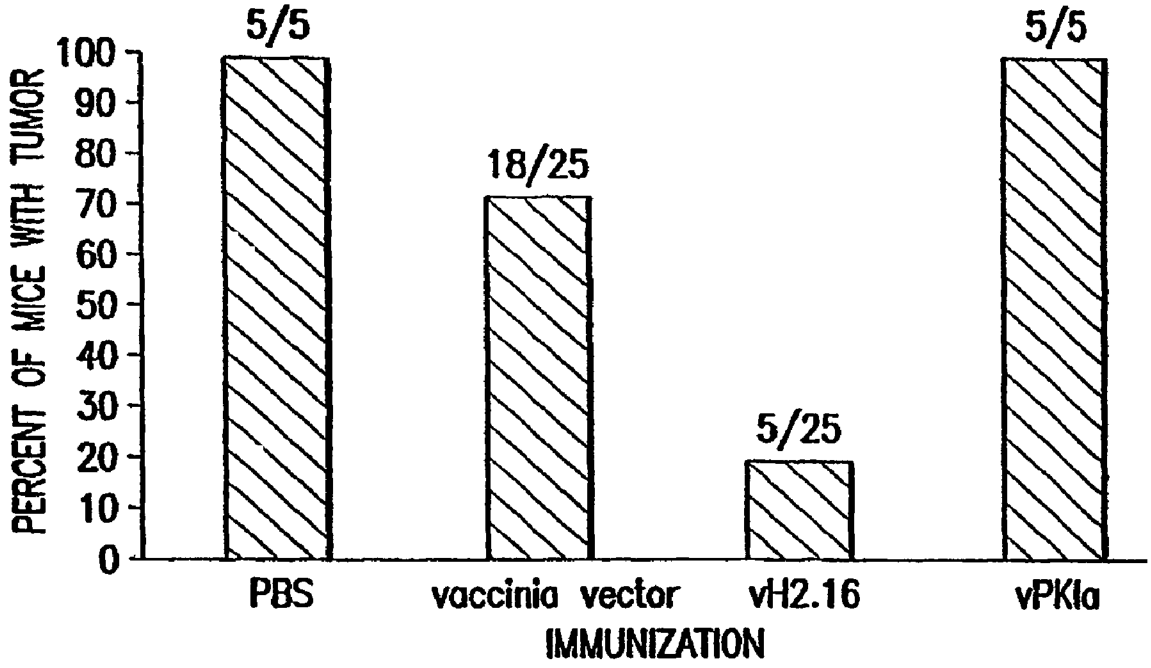
Figure 9C:
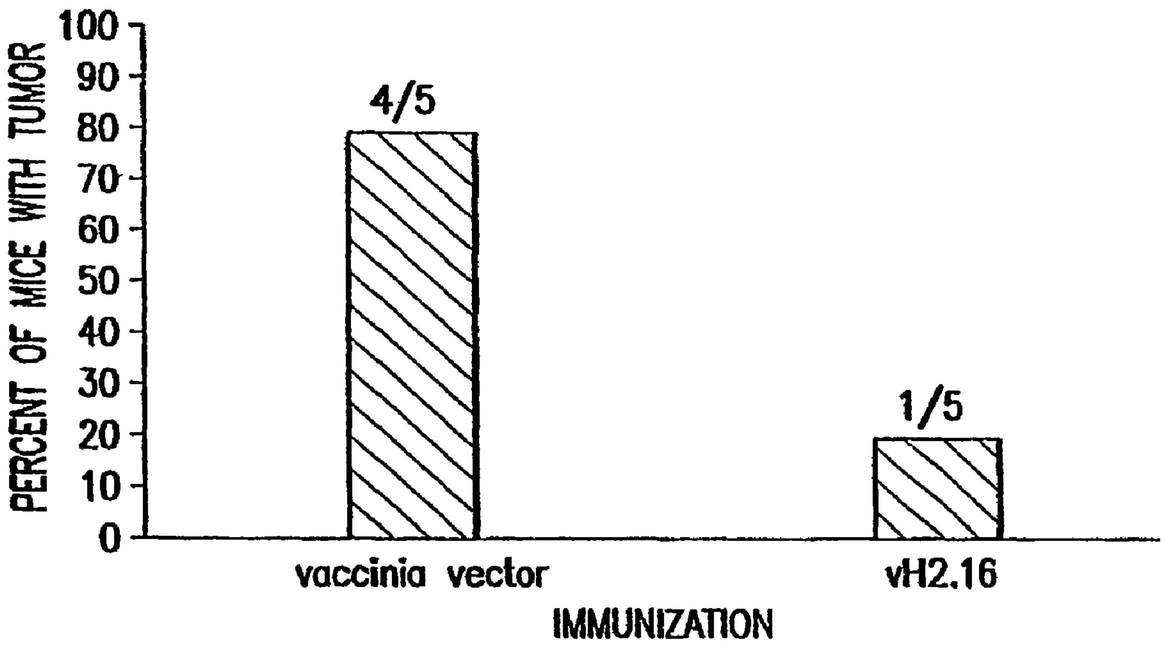

If broadly effective vaccines are to be developed based on expression of shared tumor antigens, then it is critical to demonstrate that such antigens can be immunoprotective. The largest number of shared antigens have been identified for human tumors, but clinical Immunotherapy trials employing these antigens have so far been inconclusive, in part because of uncertainty regarding optimal vaccination strategies (Pardoll, D. M., *Nat. Med.* 4:525 (1998)). In mice, where immunotherapeutic strategies could be more thoroughly investigated, very few shared tumor antigens have been identified. It was, therefore, of considerable interest to determine whether immunization with iL3 recombinant vaccinia virus would induce tumor specific CTL and protect mice from tumor challenge (Overwijk et al., *Proc. Natl. Acad. Sci.* 96:2982 (1999); Moss, B., *Science* 252:1662 (1991); Irvine et al., *J. Immunology* 154:4651 (1995); McCabe et al., *Cancer Research* 55:1741 (1995); Estin et al., *Proc. Natl. Acad. Sci.* 85:1052 (1988); J. Kantor et al., *JNCI* 84:1084 (1992); V. Bronte et al., *Proc. Natl. Acad. Sci.* 94:3183 (1997)). Immunization of Balb/c mice with vaccinia virus recombinant for the iL3 gene (H2.16) generated CTL that were able to lyse both BCA 34 and BCA 39 tumor cells, but not B/C.N in vitro (FIG. 9A). Mice immunized twice or even once with vaccinia virus recombinant for iL3 were able to reject challenge with BCA 34 tumor cells (FIGS. 9B and 9C). Mice immunized with empty viral vector, or control vaccinia recombinant for the Inhibitor Protein of cAMP-dependent Protein Kinase (PKIa) were unable to reject this tumor challenge (Olsen, S. R. and Uhler, M. D., *J. Biol. Chem.* 266:11158 (1991); Mueller et al., Manuscript in Preparation). These results demonstrate that the iL3 self-protein is an immunoprotective tumor antigen.

The present inventors have developed a new strategy to identify genes that encode CTL epitopes based on CTL-mediated selection from a tumor cDNA library in a modified vaccinia virus vector (Merchlinsky et al., *Virology* 238:444 (1997); E. Smith et al., manuscript in preparation). We have applied this strategy to identify a deregulated housekeeping gene that encodes a tumor rejection antigen shared by three independently derived murine tumors. This ribosomal protein may be representative of a larger class of immunoprotective shared tumor antigens that become immunogenic as a result of deregulated expression of self-proteins without compromising immune tolerance to normal tissues. Such antigens would be well suited for immunotherapy of cancer in vital organs.

Example 5

Expression and Immunogenicity of C35 Tumor Antigen

RNA transcripts of the novel C35 tumor gene are overexpressed in 70% (12/17) of primary human breast carcinomas examined and 50% (5/10) of bladder carcinomas examined when compared to expression in normal human tissues. The full-length gene encodes a novel 115 amino acid protein of unknown function. A monoclonal antibody, 2C3, has been selected that stains the surface membrane of cells expressing C35 by flow cytometric analysis. In addition, human cytotoxic T lymphocytes (CTL) have been generated in vitro that specifically lyse C35+ breast and bladder tumors. The ability to generate C35-specific CTL in vitro from normal human donors suggests the absence of tolerance to the overexpressed protein. Overexpression of C35 in tumors of different individuals and the ability to induce humoral and cellular immune responses make C35 a promising candidate for immunotherapy.

Material and Methods

Cell lines: Human mammary carcinoma cell lines BT20, BT474, MCF7, MDA-MB231, SKBR3, T47D (supplied by ATCC) were grown in RPMI-1640 (BioWhitaker, Walkersville, Md.) supplemented with 10% fetal bovine serum (BIOFLUIDS®, Rockville, Md.). An immortalized line derived from normal breast epithelium, H16N2, two metastastic tumors, 21-MT1 and 21-MT2, and two primary tumors, 21-NT and 21-PT all derived from the same patient, and grown in DFCI medium (Band, V. and Sager, R., "Tumor Progression in Breast Cancer" in *Neoplastic Transformation in Human Cell Culture*, J. S. Rhim and A. Dritschilo eds., The Human Press Inc., Totowa, N.J. (1991), pp. 169-78) were generously provided by Dr. Vimla Band, New England-Tufts Medical Center. The bladder tumor cell line ppT11A3 was derived from the immortalized nontumorigenic cell line SV-HUC. These bladder cell lines were generously provided by Dr. Catherine Reznikoff, University of Wisconsin Clinical Cancer Center, and grown in F12 medium supplemented with 1% FBS, 0.025 units insulin, 1 ug hydrocortisone, 5 ug transferrin, 2.7 g dextrose, 0.1 uM non-essential amino acids, 2 mM L-glutamine, 100 units penicillin, and 100 ug streptomycin per 500 ml. Normal proliferating breast epithelial cells (MEC) were purchased from CLONETICS® (BioWhittaker) and maintained according to the supplier's directions.

RNA extraction and Northern Blot Analysis: Cell lines were harvested for RNA extraction at approximately 80% confluency. Cells were harvested and lysed in QG buffer from Qiagen RNAEASY™ kit. Total RNA was extracted as per manufacturer's protocol and stored at −80° C. as precipitates with GITC and alcohol. Tissue samples were provided by the Cooperative Human Tissue Network as snap frozen samples, which were homogenized in lysis buffer for use in the RNAEASY™ protocol. For Northern blots, mRNA was extracted from total RNA (30 ug total RNA/well) using Dynal's (Lake Success, N.Y.) oligo-$dT_{25}$ magnetic beads and electrophoresed in 0.8% SEAKEM™ LE (FMC Bioproducts) with 3% formaldehyde. The mRNA was blotted onto GENESCREEN PLUS™ (NEN) in 10×SSC overnight by capillary blot, then baked for 2 hours at 80° C. Membranes were probed with random-primed $^{32}P$-labeled cDNA probes (PRIMEIT™, Stratagene, LaJolla, Calif.) at $10^6$ cpM/ml QUICKHYB™ solution (Stratagene), at 68° C. as per manufacturer's protocol. Blots were exposed to Xray film and/or phosphorimager screens overnight. Expression on all blots was normalized to a housekeeping gene, such as GAPDH or beta actin.

Subtractive Hybridization: PCR Select cDNA Subtraction Kit (Clontech, Palo Alto, Calif.), based on Representational Difference Analysis as first described by Lisitsyn et al. (Lisitsyn, N. and Wigter, N. M., *Science* 259:946-51 (1993)), was employed as per manufacturer's protocol to generate cDNAs enriched for genes overexpressed in tumor compared to normal breast cell lines. Briefly, oligo-dT-primed double stranded cDNA was synthesized from 2 ug high quality, DNase-treated mRNA from tumor and normal cells. Adaptors were ligated to short blunt-end (Rsa1 digested) tumor sequences and hybridized with excess Rsa1 digested normal fragments. Following 32 hour hybridization, suppression PCR (Clonte ch) allowed preferential amplification of overexpressed tumor sequences using adaptor sequences as primers. The products of the PCR amplification were cloned into pT7Blue3 (Novagen, Madison, Wis.) to generate a subtracted library. Clones were grown in LB/ampicillin (10 ug/ml) in 96-well format, inserts were PCR amplified from the overnight cultures and PCR products were spotted on GENESCREEN PLUS™ using BioDot manifold (BioRad, Hercules, Calif.). Duplicate dot blots were then probed with random-primed tumor or normal cDNA, or, alternatively, the PCR products of the forward and reverse subtractive hybridizations. Clones that appeared to be overexpressed in the tumor cDNA and forward subtraction (tumor minus normal) were analyzed by Northern Blot (as described above) to confirm differential gene expression.

cDNA library and full length gene: Oligo-dT primed double stranded cDNA was generated from SKBR3 cell line using SMART™ cDNA Synthesis (Clontech Laboratories), followed by phenol:chloroform:isoamyl alcohol extraction. Primers were synthesized (C35 sense: 5'-GCGATGACGGGGGAGCC (SEQ ID NO:2126), and C35 antisense: 5'-CCACGGAATCTTCTATTCTTTCT; (SEQ ID NO:2127; Fisher Oligos, The Woodlands, Tex.) to amplify the coding region of C35, based on the open reading frame deduced from EST homologies, Accession #W57569, in particular. PCR products were cloned into pT7Blue 3 (Novagen).

Vaccinia and Retroviral C35 recombinants: The coding sequence of C35 was subcloned from the library into vaccinia transfer plasmid, pVTK0 at BamHI/SalI sites in a defined orientation. Recombinant virus was generated by transfection of pVTK0.C35 along with NotI and ApaI digested V7.5/TK viral DNA into fowlpox virus infected BSC-1 cells. As described elsewhere (U.S. Utility patent application Ser. No. 08/935,377, now U.S. Pat. No. 6,872,518; PCT/US98/24029; T Cells Specific for Target Antigens and Vaccines Based Thereon), this is an efficient method for construction of vaccinia virus recombinants. The C35 gene was also cloned into a retroviral vector pLXSN, and viral stocks were generated by co-transfection of 293-GP cells with pVSVg for pseudotyping. Supernatants including infectious virus were collected 48 hours later.

Figure 14A:
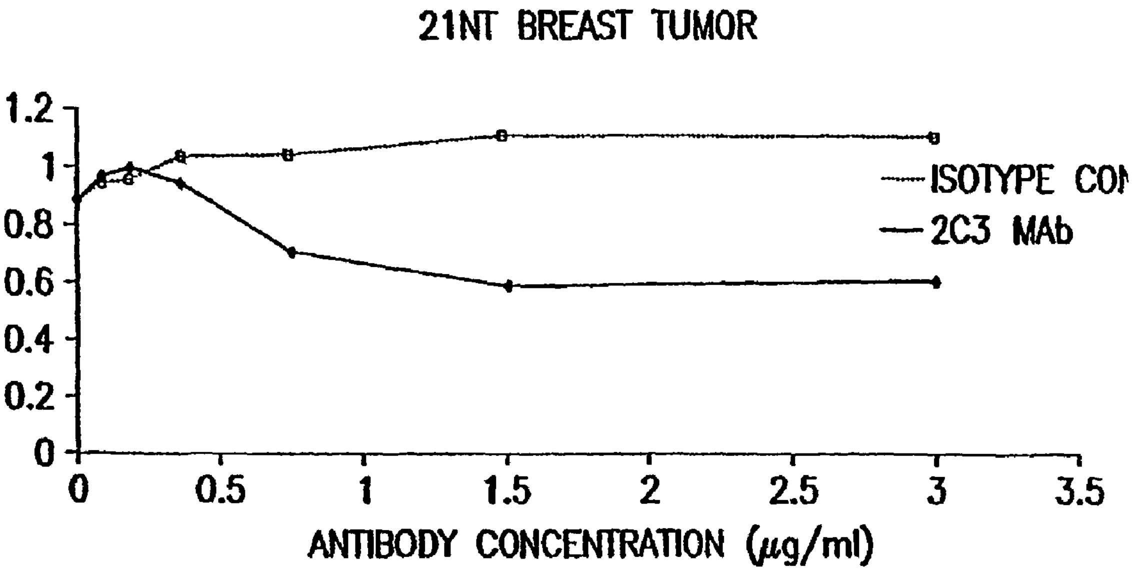
FIGS. 14A and 14B. Inhibition of Tumor Growth in Presence of 2C3 Antibody. 21NT breast tumor cells (FIG. 14A) or H16N2 normal breast epithelial cells (FIG. 14B) were incubated with the indicated concentrations of 2C3 anti-C35 monoclonal antibody or a non-specific isotype control antibody. Cell growth was measured by XTT assay following 72 hour incubation in the presence or absence of antibodies.
Figure 14B:
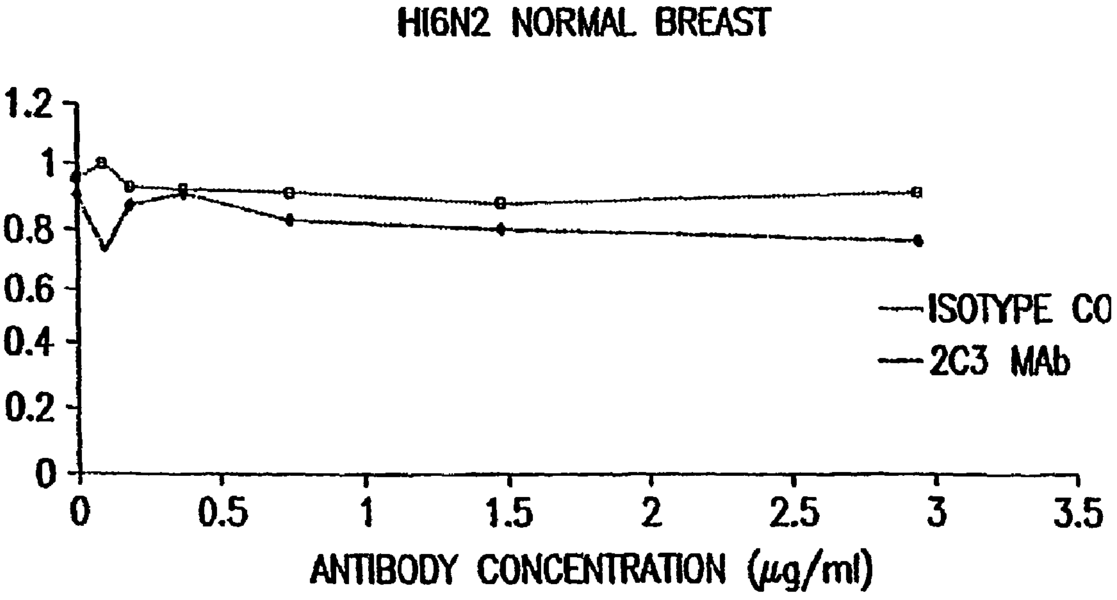

Generation of C35-specific 2C3 monoclonal antibody and FACS analysis: Line1 mouse small cell lung carcinoma cells were infected with C35-retrovirus, and $10^3$-$2\times10^4$ cells were injected into three BALB/cByJ mice. Following 21 days, serum was harvested from retro-orbital bleeds and checked for reactivity with human tumor cells known to express low (MDA-MB-231) or very high (21NT) levels of C35 mRNA. Spleens were also harvested for the production of hybridomas by the fusion of spleen cells with P3 myeloma cells using standard mouse hybridoma technology. ELISA was used to screen HAT resistant clones for the presence of Ig. High producers were isotyped, quantitated, and used to screen C35+ and C35− cell lines by flow cytometry. Hybridoma clone supernatants containing 1 ug IgG were incubated with $10^6$ cells in PAB (PBS, 1% BSA, 0.1% azide) for 30 min on ice, followed by 3 washes with PAB, and incubation with goat anti-mouse IgG conjugated to FITC (Southern Biotechnology, Birmingham, Ala.) for 30 minutes on ice. One hybridoma clone, 2C3, recapitulated the surface staining seen with the immune serum (FIGS. 14A-14B) and was selected for expansion and antibody purification (BioExpress, West Lebanon, N.Y.).

Generation of human C35-specific T cell line: Peripheral blood derived from a healthy female donor (HLA A2, 11, B35, 44) was separated into erythrocyte-rosette positive fraction (a source of total T lymphocytes) and negative fraction (a source of monocytes). The T lymphocytes were cryopreserved for later use while the monocytes were incubated under conditions to generate dendritic cells (DC). Maturation of DCs was induced as described by Bhardwaj and colleagues (Bender, A. et al., *J. Immunol. Meth.* 196:121-35 (1996); Reddy, A. et al., *Blood* 90:3640-46 (1997); Engelmayer, J. et al., *J. Immunology* 163:6762-68 (1999)) with some modifications. hGM-CSF and hIL-4 (1000 U/ml) were added every other day. At day 7, non-adherent, immature DC were incubated with a retrovirus recombinant for C35 for 6 hours in the presence of GM-CSF and IL-4. At this point, the retroviral supernatant was washed out and immature dendritic cells were subjected to maturation conditions, which again included GM-CSF, IL-4 as well as 12.5% monocyte conditioned medium (MCM). After 4 days, these mature, C35-expressing DC were used to stimulate autologous T cells at a ratio of 1 DC:50 T cells for a period of 14 days. A fresh pool of autologous DC were generated for restimulation of the T cells, but this time they were infected after 48 hours of maturation in MCM with a vaccinia virus recombinant for C35. Cytokines IL-2 (20 U/ml), IL-12 (20 U/ml) and IL-18 (10 ng/ml) were added and a 1:50 ratio of DC:T cells was maintained. Following 12 days culture, T cells were stimulated for 7 additional days with EBV-B cells infected with C35 recombinant retrovirus and with addition of IL-2 (20 U/ml) and IL-7 (10 ng/ml). Cytokines were all purchased from R&D Systems (Minneapolis, Minn.). At this point, the cells were >90% $CD8^+$ and were tested for activity in a standard $^{51}Cr$ Release assay. Briefly, one million target cells were incubated with 100 uCi $^{51}Cr$, washed, then incubated with CTL effectors for 4 hours in RPMI-1640, supplemented with 10% human AB serum (BioWhittaker). Activity of the CTL is expressed as the percent of specific lysis, measured as ($^{51}Cr$ released into the supernatant upon lysis of labeled targets by CTL−spontaneous release)/(maximal release−spontaneous release).

Results

Figure 10B:
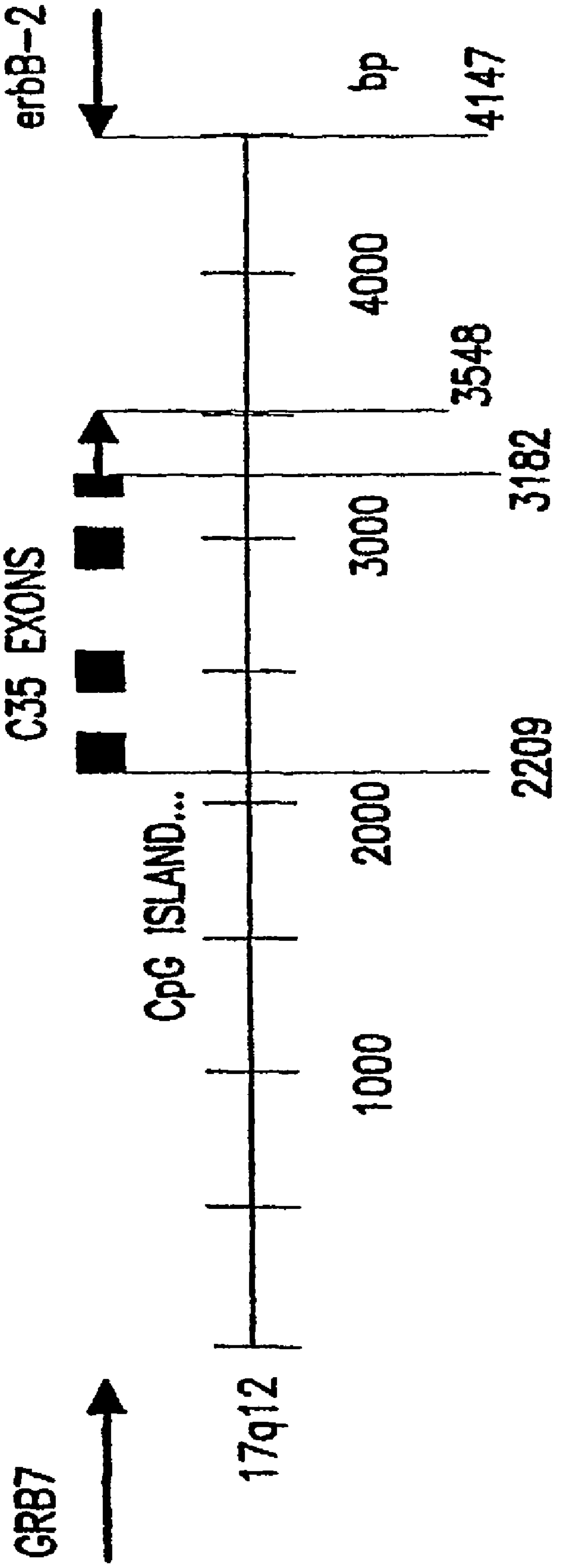

Characterization of C35: The sequence of clone C35, differentially expressed in human breast tumor cells, is not homologous to any known gene in Genbank, but homologous EST sequences (prototype Accession# W57569) were identified. Homologous human EST fragments are present in NCI CGAP (Cancer Genome Anatomy Project) libraries, including tumors of brain, lung and kidney (A# AA954696), Soares ovary (A# AA285089) and parathyroid tumors (A# W37432), an endometrial tumor (A#AA337071), and colon carcinoma (A# AA313422). An open reading frame was identified that encodes a 115 amino acid protein (FIG. 10A). The full-length gene was isolated from a cDNA library of the breast adenocarcinoma cell line SKBR3. Sequencing of full-length transcripts from the cell lines SKBR3, 21MT2-D, and H16N2 confirmed that there were no point mutations in the cDNA; the transcript is 100% homologous in $C35^{hi}$ cell lines, as well as $C35^{lo}$ cell lines. The C35 gene aligns on human chromosome 17q12 (A# AC040933) and mouse chromosome 11 (A# AC064803). Exons were deduced from homologies with cDNA EST sequences, as well as GRAIL predictions. Interestingly, the gene for C35 is within 1000 base pairs of the Her2/neu oncogene and within 2000 bp of the gene for Growth Factor Receptor-Bound Protein 7 (GRB7), a tyrosine kinase that is involved in activating the cell cycle and that is overexpressed in esophageal carcinomas (Tanaka, S. et al., *J. Clin. Invest.* 102:821-27 (1998)) (FIG. 10B). Her2/neu protein overexpression has been correlated with gene amplification in 30% breast tumors and is associated with poor clinical prognosis (Slamon, D. J. et al., *Science* 235:177-82 (1987)).

Predicted protein motifs in the C35 amino acid sequence include: casein kinase II phosphorylation sites at amino acids 38 to 41 (TYLE), 76 to 79 (SKLE), and 97 to 100 (SNGE); an N-myristoylation site at amino acids 60 to 65 (GGTGAF); and a cAMP- and cGMP-dependent protein kinase phosphorylation site at amino acids 94 to 97 (RRAS), all of SEQ ID NO:2. Finally, the C35 protein contains a prenylation motif at the COOH-terminus, amino acids 112 to 115 of SEQ ID NO:2 (CVIL). Prenylation, the covalent attachment of a hydrophobic isoprenoid moiety, is a post-translational modification that promotes membrane association and also appears to mediate protein-protein interactions (Fu, H.-W. and Casey, P. J., Recent Progress in Hormone Research 54:315-43 (1999)). Prenylation has been shown to be required for localization and transforming potential of the oncogenic Ras family proteins to the cell surface (Jackson, J. H. et al., Proc. Natl. Acad. Sci. U.S.A. 87:3042-46 (1990); Hancock, J. F. et al., Cell 57:1167-77 (1989)). Inhibitors of prenylation have been shown to possess anti-tumor activities, such as slowing tumor growth (Garcia, A. M. et al., J. Biol. Chem. 268:18415-18 (1993)) and to promote rejection in animal models (Kohl, N. E. et al., Nature Med. 1:792-97 (1995)). Three O-glycosylation sites are predicted at or near the amino terminus—thr8, ser2, and ser9 using NetOGlyc2.0.

Figure 11A:
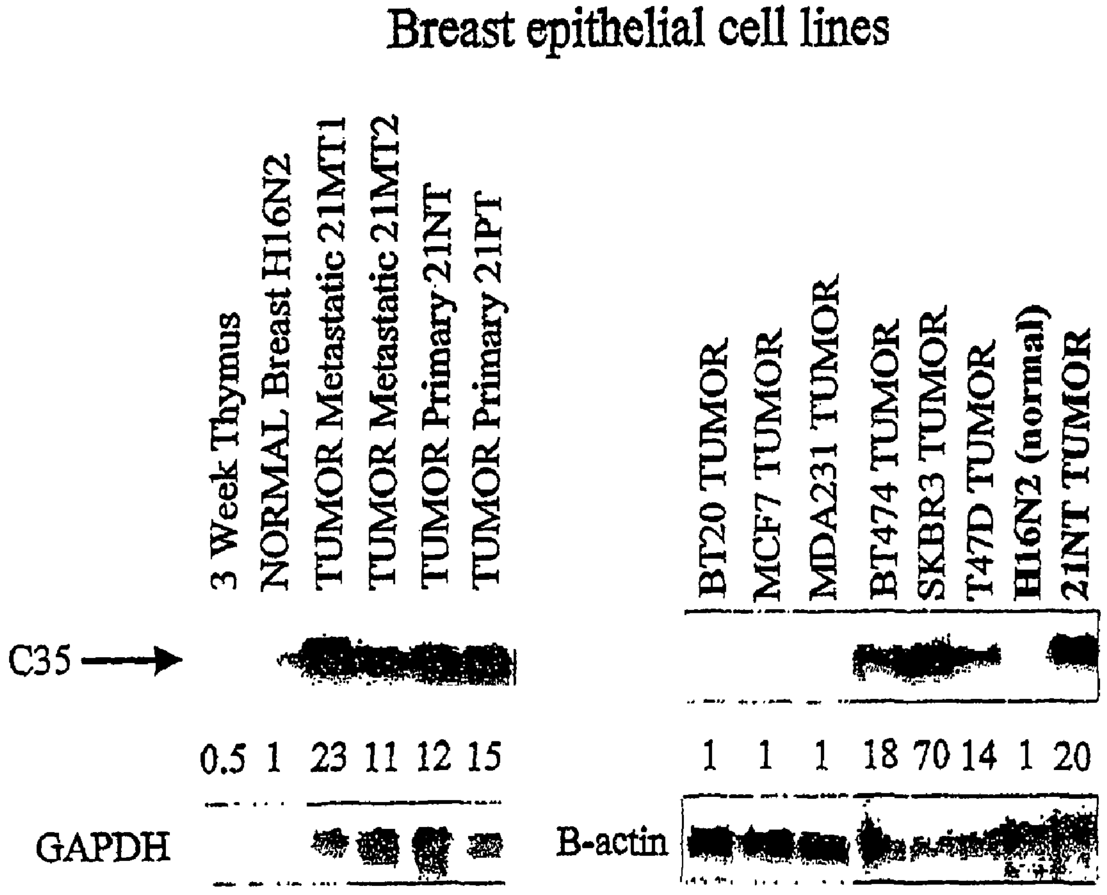
FIGS. 11A and 11B. C35 Expression in Breast Carcinoma. C35 was labeled with $^{32}P$ in a random priming reaction and hybridized to Northern blots at $10^6$ cpm/ml. Each blot was stripped and re-probed with GAPDH or Beta-actin to normalize mRNA loads. The numbers indicate densitometry ratios normalized against GAPDH/Beta-actin. A value of 1 has been assigned to normal cell line H16N2, and all values are relative to the level of expression in the normal cell line.

C35 Transcript is Overexpressed in Breast and Bladder Carcinoma: An ideal target antigen for tumor immunotherapy would be abundantly expressed in multiple independent carcinomas, and would be absent or minimally expressed in normal proliferating and vital tissues. Differential expression of C35 was confirmed by Northern blot analysis. C35 is expressed in 7/10 human tumor cell lines at levels 10-25× higher than expression in a normal immortalized breast epithelial cell line, H16N2 (FIG. 11A). Importantly, C35 expression is shared among lines derived from both primary (21NT, 21PT) and metastatic (21MT1, 21MT2) lesions of a single patient, suggesting its expression may be associated with early events in the process of tumor transformation. In addition, the overexpression of C35 is shared among independently derived human mammary carcinoma cell lines, including SKBR3, T47D, and BT474. Interestingly, the C35 expression pattern in SKBR3, MDA MB231, H16N2 and tumors derived from the same patient correlates with Her2/neu expression, which may be associated with the close genomic proximity of the two genes and the incidence of HER2/neu gene amplification.

Figure 11B:
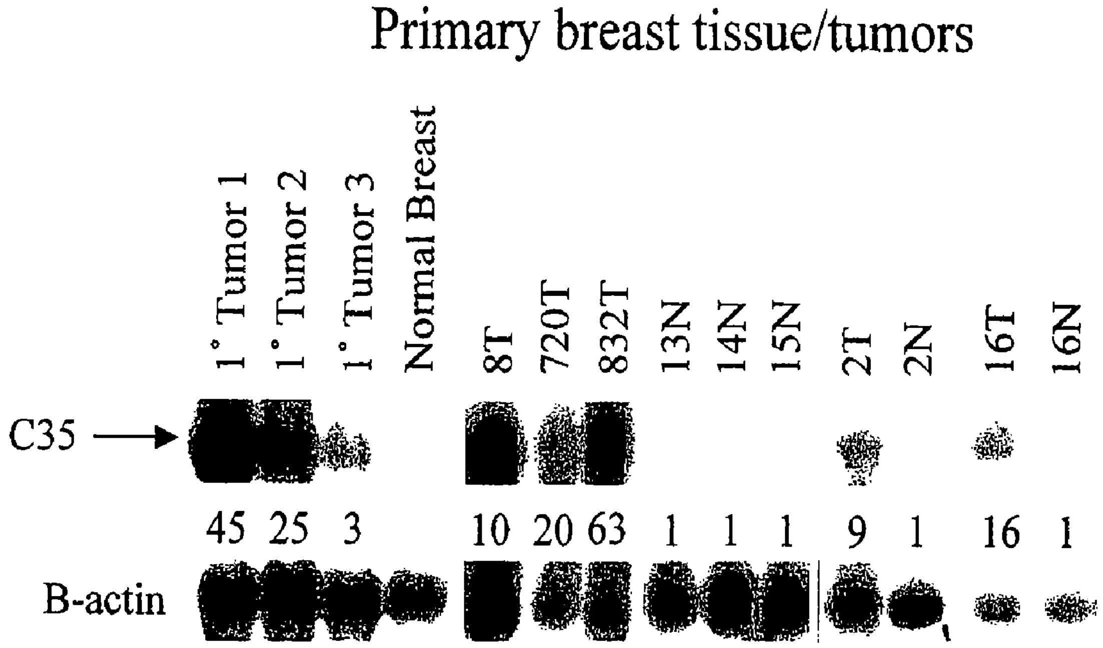

To investigate whether C35 expression in patient derived tumors is clinically relevant for development of a cancer vaccine, mRNA was extracted from snap frozen human tissue samples obtained from the Cooperative Human Tissue Network (CHTN). 70% of primary breast tumor samples overexpress C35 transcript (FIG. 11B), and 35% (7/20) of these breast adenocarcinomas overexpress at levels 10-70 fold higher than normal breast. Overexpression of C35 is also seen in 50% of bladder carcinoma primary specimens examined (FIG. 12), while 20% (3/14) of primary bladder carcinoma express at levels greater than 10 fold higher than normal bladder. Overexpression of C35, at levels 9× or greater, was not detected in panels of ovarian (0/7), prostate (0/5), or colon (0/15) carcinomas (data not shown).

Figures 1, 13A:
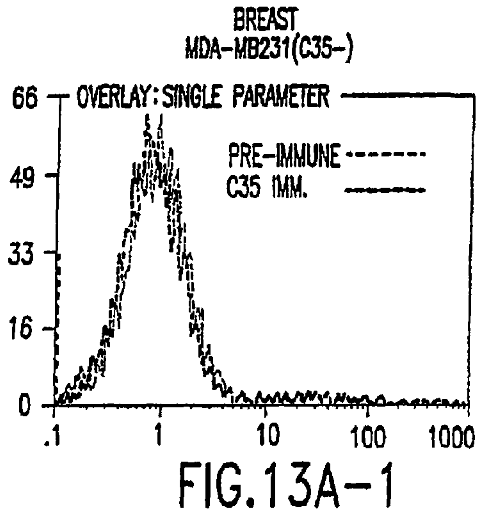
FIGS. 13A and 13B. FACS Analysis with Anti-C35 Antibodies.
Figures 2, 13A:
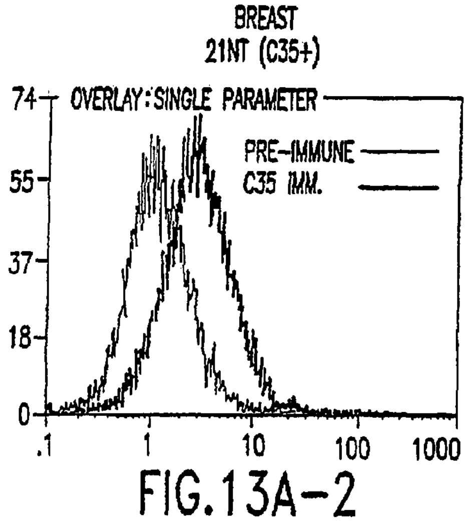
Figures 3, 13A:
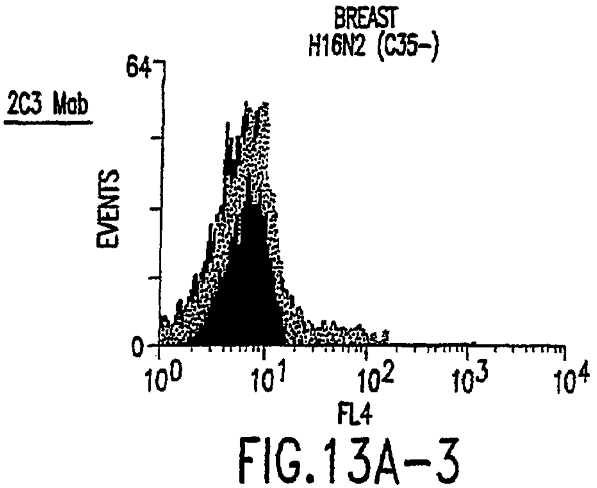
Figures 4, 13A:
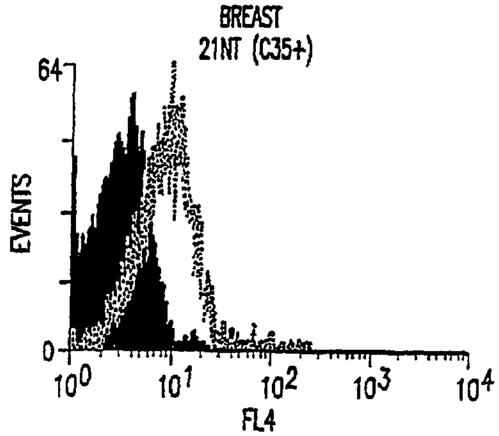
Figures 1, 13B:
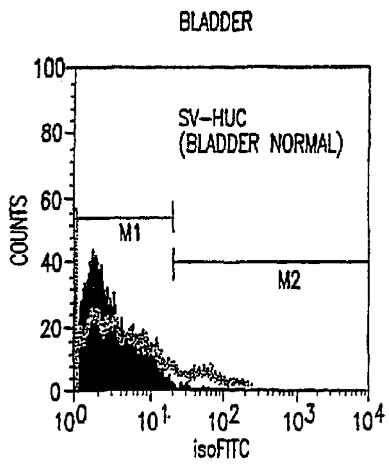
Figures 2, 13B:
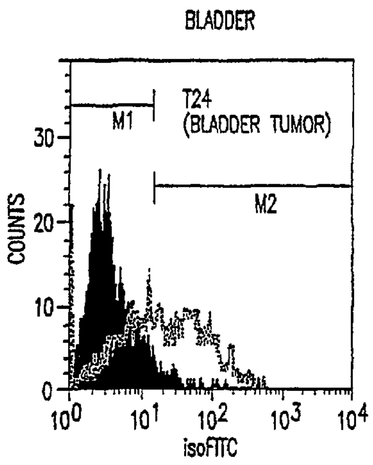
Figures 3, 13B:
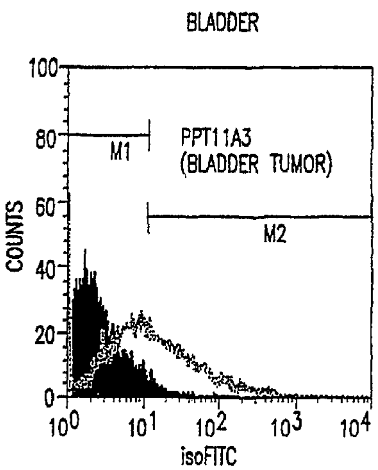

2C3 Monoclonal Antibody reacts with C35+ cells: In order to confirm differential expression of the gene product encoded by C35, a monoclonal antibody against the shared tumor antigen was selected. Hybridomas were produced by immunizing mice with a poorly immunogenic BALB/cByJ tumor cell line, which had been transduced with a retroviral human C35 recombinant. Hybridoma clones were screened for their ability to stain C35++breast and bladder tumor cell lines (FIGS. 13A and 13B). Non-tumorigenic breast H16N2 and bladder SV-HUC epithelial cell lines did not show a significant shift in fluorescence intensity when compared to the isotype control. In contrast, 2C3 monoclonal antibody specifically stained C35+ breast tumors, SKBR3 and 21-NT-D, and bladder tumor ppT11A3. The staining was carried out on cells that were neither fixed nor permeabilized, indicating that 2C3 antibody recognizes a surface molecule.

Inhibition of Tumor Growth with C35 Antibodies:

Antibodies are useful tools to detect diagnostic markers of cancer, but they may also have potential use for therapeutic applications. Humanized Her2/neu specific antibody (HERCEPTIN™) has been successfully employed for treatment of some breast cancers. HERCEPTIN™ binds HER2/neu and downregulates signal transduction from the growth factor receptor. Growth inhibition studies were performed with C35-specific 2C3 antibody. 21NT-D breast tumor and H16N2 "normal" breast cell lines were grown in vitro in the presence of various antibody concentrations. An XTT assay was performed to evaluate cell expansion at 72 hours. Results shown in FIGS. 14A and 14B indicate that 2C3 inhibits growth of 21NT tumor cells by approximately 50% at concentrations as low as 1 ug/ml.

A C35 Class I Epitope is HLA-A2 Restricted:

Establishment of self-tolerance is a major obstacle to development of vaccines based on self proteins. Tolerance, however, must be defined in terms of quantitative levels of expression. It is possible that even while high affinity antigen-specific T cells are tolerized, T cells with lower affinity receptors that do not have functional avidity for a low concentration of antigen escape tolerance induction. These same T cells could, however, subsequently become functionally significant if there is markedly increased avidity associated with overexpression of the target antigen. Even if they are few in number, such T cells could be expanded by the most fundamental of immunological manipulations, vaccination.

C35 is a self-protein expressed at low basal levels in normal human tissues. It was, therefore, necessary to determine if human T cells are tolerant to C35 at levels of expression characteristic of carcinomas. The only way to exclude tolerance is by demonstrating responsiveness, and the only way to demonstrate responsiveness short of a clinical trial is by in vitro stimulation. Human T cells and autologous dendritic cells were derived from PBL from a normal donor. The T cells were primed by alternate stimulation with autologous dendritic cells infected with retroviral or pox virus recombinants of the C35 cDNA. CTL recovered in vitro following several cycles of stimulation were analyzed for their ability to lyse C35+ target tumor cells (FIGS. 15A and 15B) or to secrete cytokines in response to antigen induced activation (FIGS. 16A and 16B). The targets either endogenously expressed C35 and/or HLA-A2.1, or were engineered to express these proteins via standard transfection with a C35-recombinant mammalian expression vector, or by infection with C35-recombinant vaccinia virus. Previous studies have demonstrated that protein expression by vaccinia virus is an efficient means of targeting peptides to the MHC-I processing pathway (Moss, B., *Science* 252:1662-67 (1991).

Figure 15A:
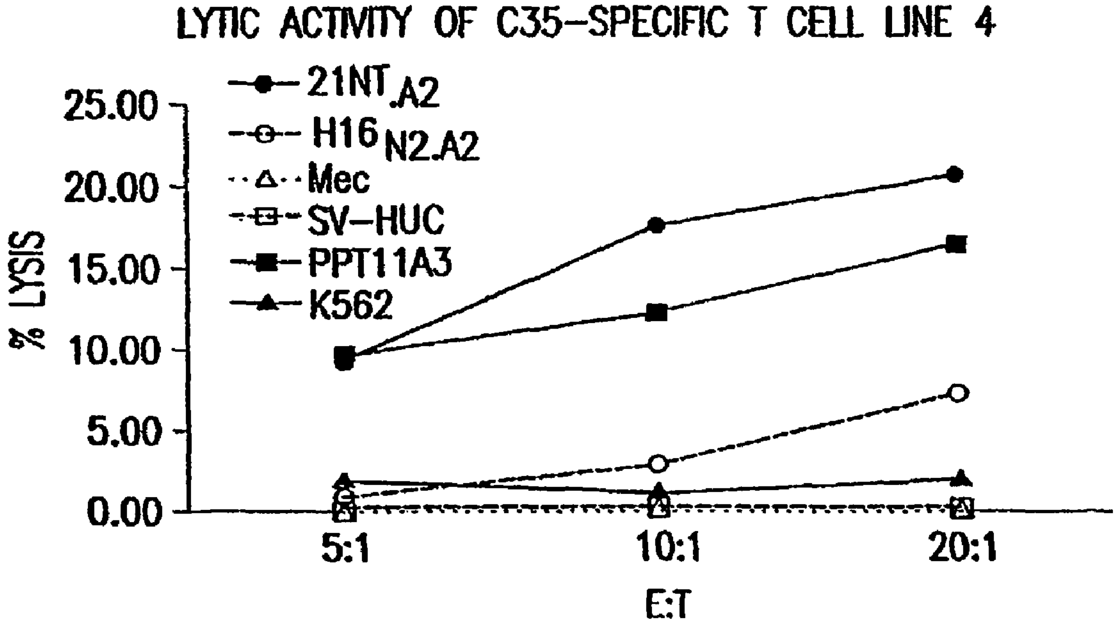
FIGS. 15A and 15B. CTL stimulated with C35 expressing dendritic cells specifically lyse C35+Breast (21NT) and Bladder (ppT11A3) tumor cell lines, with minimal activity against normal breast (MEC), immortalized non-tumorigenic breast (H16N2) and bladder (SV-HUC) cell lines, or an NK sensitive cell line (K562).
Figure 15B:
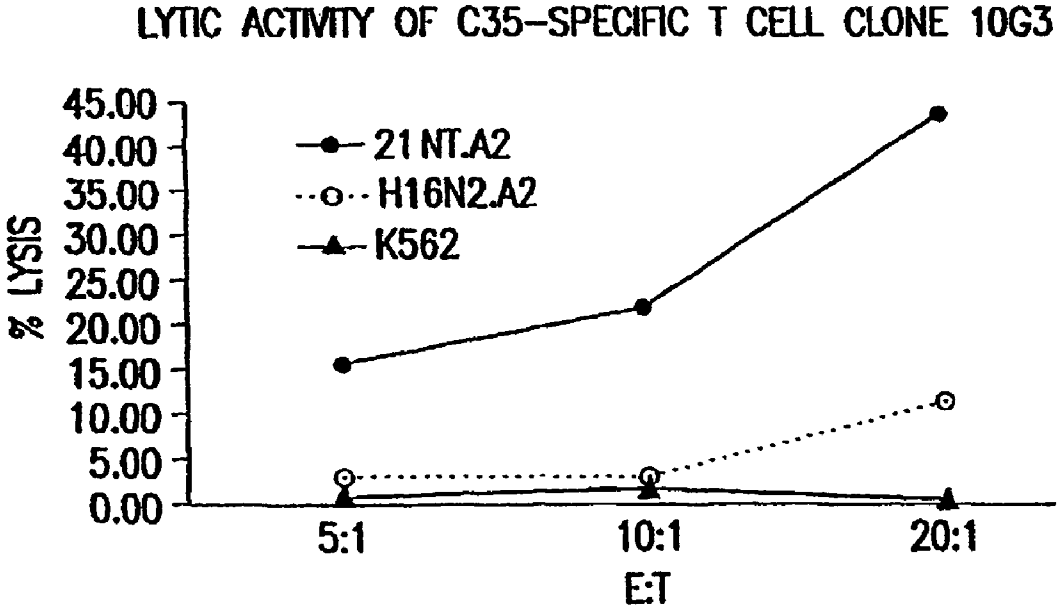
Figure 16A:
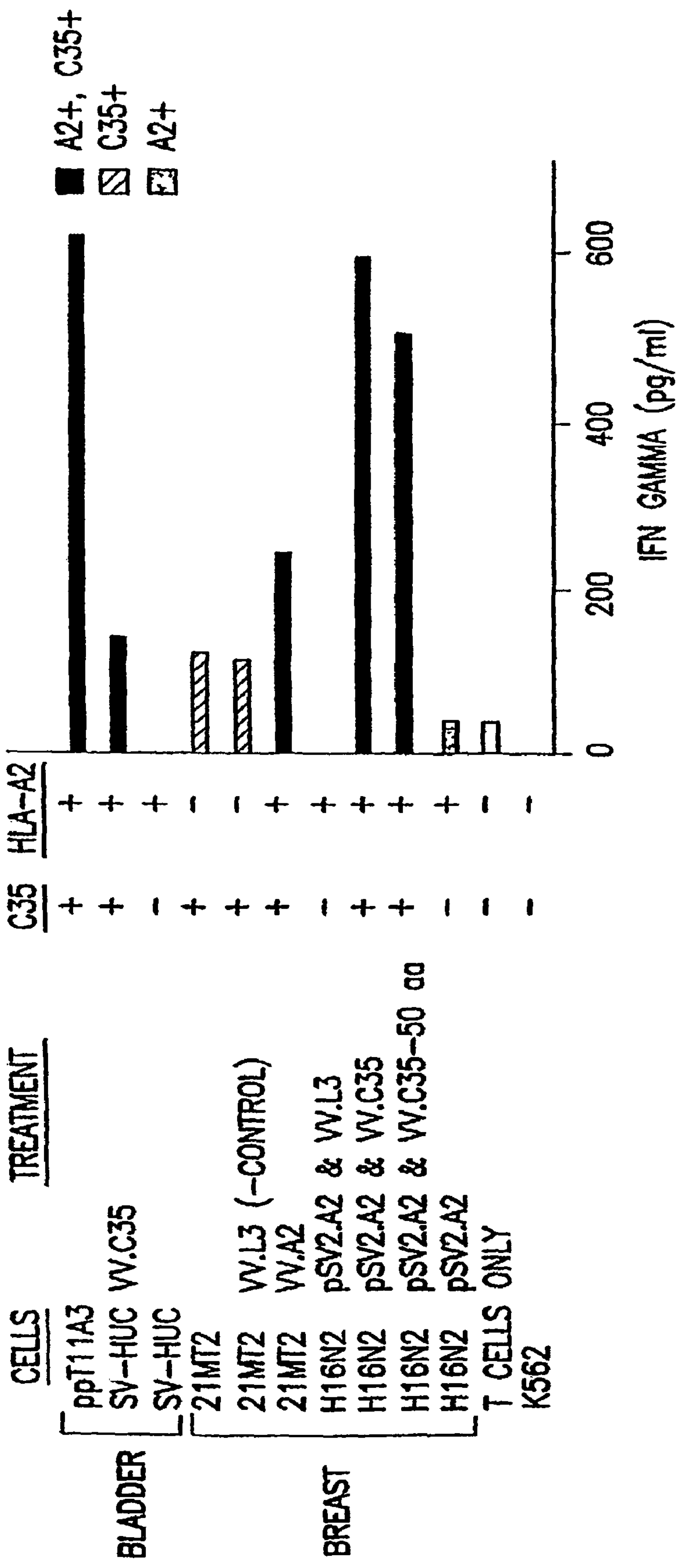
FIGS. 16A and 16B. Cytokine Release from T Cell Clone 10G3 upon Stimulation with Targets.
Figure 16B:
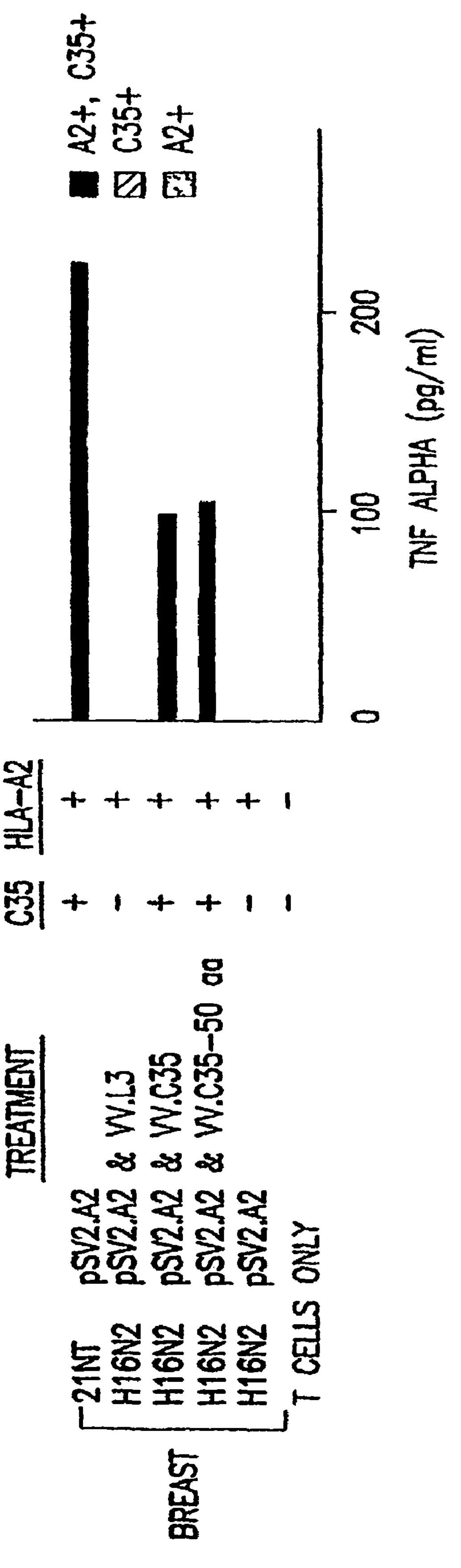

Following several rounds of stimulation, both a bulk T cell line and a T cell clone were selected that differentially lyse C35+ tumor cells relative to $C35^{lo}$ H16N2 normal breast epithelial cell line in a $^{51}Cr$ release assay (FIGS. 15A and B). The HLA-A2 restricted C35-specific CTL clone 10G3 efficiently lysed the HLA-A2 transfected tumorigenic cell line, 21-NT.A2, which expresses C35 antigen at levels 15× greater than H16N2 and is stained with 2C3 monoclonal antibody. Specific lysis was also with the HLA-A2+ bladder tumor cell line ppT11A3 compared to the non-tumorigenic bladder cell line SV-HUC from which it was derived (FIG. 15B). The data demonstrate CTL sensitivity of tumors that express high levels of C35 with minimal lysis of C3511 nontumorigenic immortalized cell lines. Importantly, the same CTL are not reactive with MEC, a primary culture of non-immortalized, non-transformed, HLA-$A2^+$ breast epithelial cells that do not express C35 at significant levels. Further evidence to support C35+ tumor recognition by the T cells is shown in FIGS. 6A and 16B. The T cells secrete IFN-gamma and TNF-alpha in response to C35+, HLA-A2+ stimulator. Again, the non-tumorigenic, $C35^{lo}$ cell line H16N2.A2 did not induce cytokine secretion by C35-specific T cells. However, infection of this line with vaccinia virus recombinant for C35 confers the ability to activate the T cells. Since the T cells do not secrete IFN-gamma or TNF-alpha in response to H16N2.A2 transduced with an irrelevant protein L3, this indicates that the response is specific to C35 protein expression (FIGS. 16A and B).

Following several rounds of stimulation, both a bulk T cell line and a T cell clone were selected that differentially lyse C35+, HLA-A2+ tumor cells in a $^{51}Cr$ release assay. The C35-specific CTL did not lyse the HLA-A2 transfected non-tumorigenic breast epithelial cell line, H16N2.A2 (FIGS. 15A and 15B), although this cell line does express C35 at low levels based on the Northern blot data shown in FIG. 11A. However, C35-specific CTL efficiently lysed the HLA-A2 transfected tumorigenic cell line, 21-NT.A2, which expresses C35 antigen at levels 15× greater than H16N2 and is stained with 2C3 monoclonal antibody. $C35^+$ tumor-specific lysis was also shown with the bladder tumor cell line ppT11A3 compared to the non-tumorigenic bladder cell line SV-HUC from which it was derived. The data demonstrate CTL sensitivity of tumors that express high levels of C35 with minimal lysis of $C35^{lo}$ nontumorigenic immortalized cell lines. Importantly, the same CTL are not reactive with MEC, a primary culture of non-immortalized, non-transformed, HLA-$A2^+$ breast epithelial cells that do not express C35 at significant levels. Further evidence to support C35+ tumor recognition by the T cells is shown in FIGS. 16A and 16B. The T cells secrete IFN-gamma and TNF-alpha in response to C35+, HLA-A2+ stimulator. Again, the non-tumorigenic, $C35^{lo}$ cell line H16N2.A2 did not induce cytokine secretion by C35-specific T cells. However, infection of this line with vaccinia virus recombinant for C35 confers the ability to activate the T cells. Since the T cells do not secrete IFN-gamma or TNF-alpha in response to H16N2.A2 transduced with an irrelevant protein L3, this indicates that the response is specific to C35 protein expression.

The C35-specific T cells were generated from a donor with HLA haplotype A2, A11, B8, B35. The bladder cell lines, SV-HUC and ppT11A3 derive from a donor with haplotype HLA-A2, B18, B44. However, since the H16N2 immortalized breast epithelial cell line and 21-NT and 21-MT breast tumor cell lines derived from the same HLA-A2 negative donor, these cell lines had to be transfected with HLA-A2.1 to provide a required MHC restriction element for recognition by HLA-A2 restricted 10G3 T cell clone (FIGS. 16A and 16B). The T cells were strongly stimulated to secrete these lymphokines by the breast lines that expressed both C35 and HLA-A2 (compare 21-MT2 with 21-MT2.vvA2). The data indicate that there is at least one HLA-A2.1 defined epitope of C35.

Deletion mutants of C35 coding region were constructed to identify cDNA segments that encode the peptide epitope recognized by the CTL. FIGS. 15A and 15B demonstrate almost equivalent IFN-gamma and TNF-alpha secretion by T cells stimulated with the full length C35 or a truncated mutant encompassing only the first 50 amino acids.

Discussion

C35 is a novel tumor antigen that is overexpressed in breast and bladder carcinoma. The gene has properties that make it a promising candidate for tumor immunotherapy. It is expressed in a significant number of tumors derived from different individuals. Expression in vital normal tissues is relatively low, reducing the risk of autoimmune reactions and, equally important, making it unlikely that immune cells have been rendered tolerant to the gene product. C35 is characterized as a "tumor antigen" since C35 expressing dendritic cells induce autologous tumor specific human cytotoxic T lymphocytes in vitro.

C35 is a novel gene product of unknown function. However, our studies with monoclonal antibodies have provided some insight into the localization of the protein. Both serum and a monoclonal antibody derived from a C35-immunized mouse specifically stain unfixed cells that express C35. This suggests that the antibody recognizes a tumor surface membrane protein. Although the protein sequence does not conform with known transmembrane motifs based on hydrophobicity, the existence of a prenylation site at the COOH terminus suggests insertion into the membrane. Prenylation is a post-translational lipid modification that produces a substantially more hydrophobic protein with high affinity for the membrane (Fu, H.-W. and Casey, P. J., *Recent Progress in Hormone Research* 54:315-43 (1999)). Other proteins that contain prenylation sites include the Ras oncogene family. Ras GTPases act in signal transduction cascades with MAPK to induce cell division and proliferation. Ras proteins are anchored to the plasma membrane via prenylation, but the proteins remain in the cytoplasmic face of the membrane. Therefore, it is possible that C35 also remains on the cytoplasmic side of the membrane, but there may be sufficient transport to the outer surface to be detected with a specific antibody.

C35-specific antibodies are valuable tools for studying the protein expression of C35, to corroborate Northern blot analysis, and for use in assays such as Western blots and immunohistochemistry. In addition, these antibodies may have therapeutic benefits, such as has been recently been demonstrated for HERCEPTIN™ (Baselga, J. et al., *J. Clin. Oncol.* 14:737-44 (1996); Pegram, M. D. et al., *J. Clin. Oncol.* 16:2659-71 (1998)), an antibody to the tumor-associated antigen HER2-neu (c-erbB-2) (Schechter, A. L. et al., *Nature* 312:513-16 (1984). HERCEPTIN™'s anti-tumor effects include binding the epidermal growth factor receptor, which inhibits tumor cell growth, and eliciting antibody dependent cell-mediated cytotoxicity (Dillman, R. O., *Cancer Biotherapy & Radiopharmaceuticals* 14:5-10 (1999).

Example 6

Induction of Cytotoxic T Cells Specific for Target Antigens of Tumors

Human tumorspecific T cells have been induced in vitro by stimulation of PBL with autologous tumors or autologous antigen presenting cells pulsed with tumor lysates (van Der Bruggen, P. et al., *Science* 254: 16431647 (1991); Yasumura, S. et al., *Cancer Res.* 53: 146168 (1993); Yasumura, S. et al., *Int. J. Cancer* 57: 297305 (1994); Simons, J. W. et al., *Cancer Res.* 57: 153746 (1997); Jacob, L. et al., *Int. J. Cancer* 71:325332 (1997); Chaux, P. et al., J. Immunol. 163:29282936 (1999)). PBL have been derived from either patients deliberately immunized with tumor, with tumor modified to enhance its immunogenicity, or with tumor extracts, or patients whose only prior stimulation was in the natural course of disease. T cells with reactivity for infectious agents could be similarly derived by in vitro stimulation of T cells with autologous cells that have been either infected in vitro or were infected in vivo during the natural course of exposure to the infectious agent. CD4+ and CD8+ T cells or antibody selected under these or other conditions to be specific for either tumor cells or cells infected with either a virus, fungus or mycobacteria or T cells or antibodies specific for the target antigens of an autoimmune disease could be employed in the selection and screening methods of this invention to detect and isolate cDNA that encode these target antigens and that have been incorporated into a representative cDNA library.

Figure 17A:
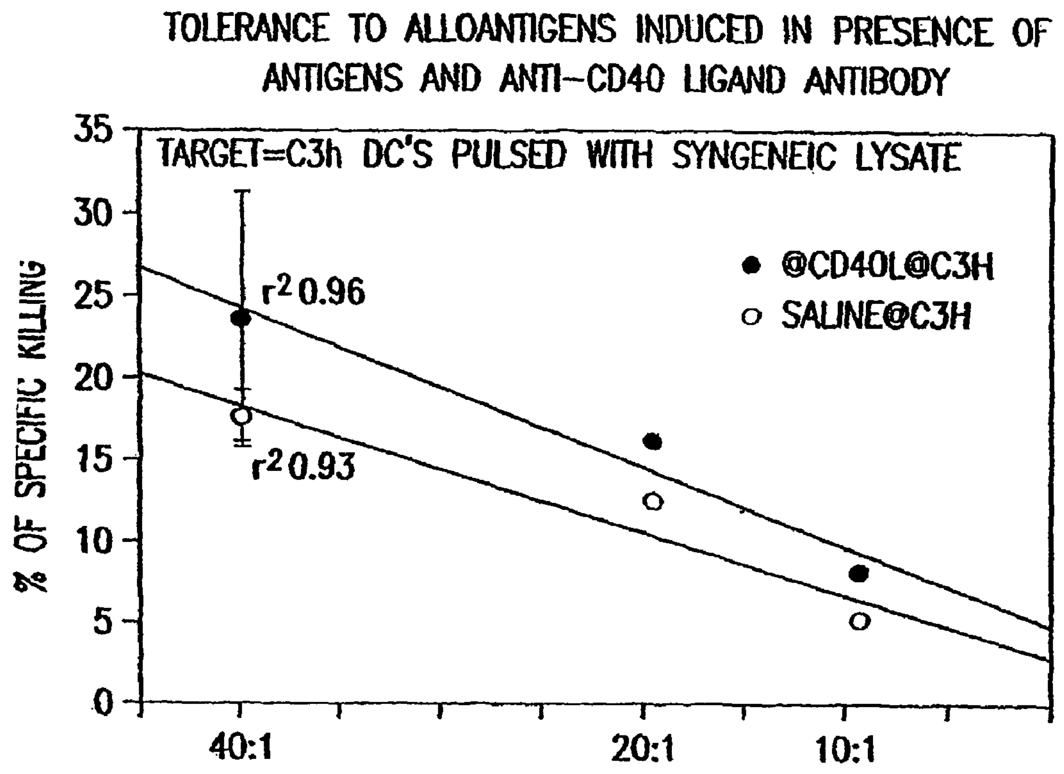
FIGS. 17A and 17B. Effect of anti-CD40 ligand antibody (anti-CD154) in blocking the reactivity of murine T cells to specific transplantation antigens. DBA/2 (H-$2^d$) mice were immunized with $10^7$ C57B1/6 (H-$2^b$) spleen cells intraperitoneally and, in addition, were injected with either saline or 0.5 mg monoclonal anti-CD40 ligand antibody (MR1, anti-CD154, Pharmingen 09021D) administered both at the time of immunization and two days later. On day 10 following immunization, spleen cells from these mice were removed and stimulated in vitro with either C57B1/6 or control allogeneic C3H(H-$2^k$) spleen cells that had been irradiated (20 Gy). After 5 days of in vitro stimulation, C57B1/6 and C3H specific cytolytic responses were assayed at various effector: target ratios by $^{51}Cr$ release assay from specific labeled targets, in this case, either C3H or C57B1/6 dendritic cells pulsed with syngeneic spleen cell lysates. Significant cytotoxicity was induced against the control C3H alloantigens in both saline and anti-CD154 treated mice (FIG. 17A) whereas a cytotoxic response to C57B1/6 was induced in the saline treated mice but not the anti-CD154 treated mice (FIG. 17B).
Figure 17B:
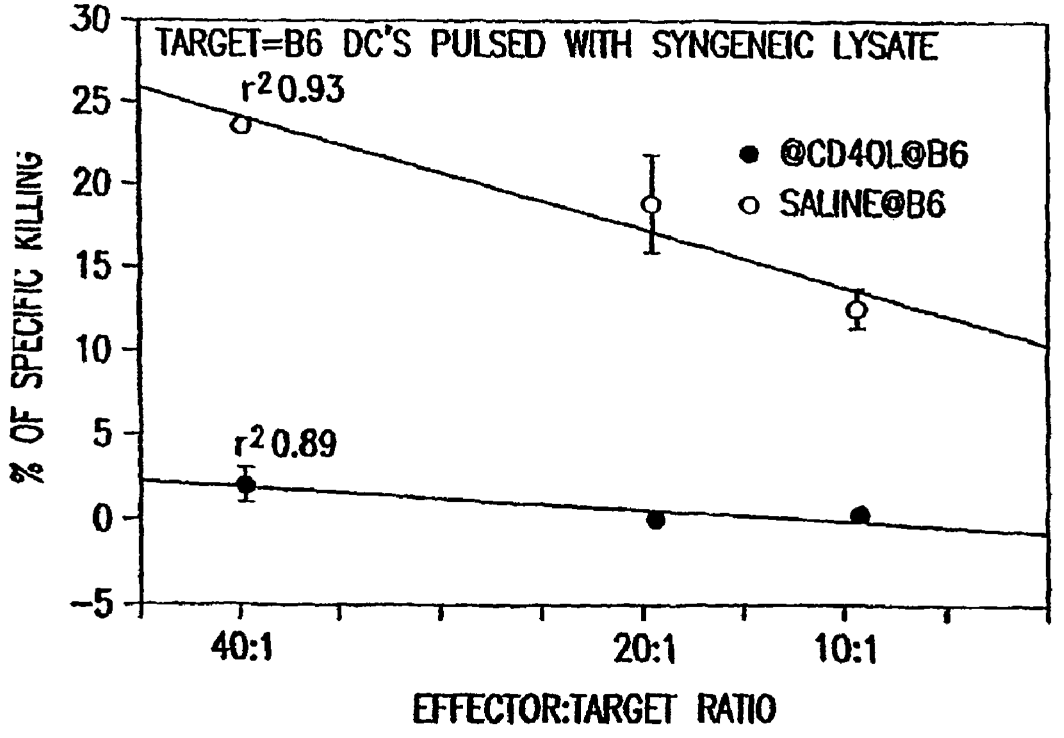

In spite of demonstrated success in the induction of human T cell responses in vitro against a number of antigens of tumors and infected cells, it is not certain that these represent the full repertoire of responses that might be induced in vivo. Because safety considerations limit the possibilities of experimental immunization in people, there is a need for an alternative animal model to explore immune responses to human disease antigens. The major obstacle to developing such a model is that numerous molecules expressed in normal human cells are strongly immunogenic in other species. It is, therefore, necessary to devise a means of inducing tolerance to normal human antigens in another species in order to reveal immune responses to any human diseasespecific antigens. It is now recognized that activation of antigenspecific T lymphocytes requires two signals of which one involves presentation of a specific antigenic complex to the T cell antigen receptor and the second is an independent costimulator signal commonly mediated by interaction of the B7 family of molecules on the surface of the antigen presenting cell with the CD28 molecule on the T cell membrane. Delivery of an antigenspecific signal in the absence of a costimulator signal not only fails to induce T cell immunity but results in T cell unresponsiveness to subsequent stimulation (Lenschow, D. J. et al., *Ann. Rev. Immunol.* 14:233258 (1996)). Additional studies have revealed a key role for another pair of interactions between the CD40 molecule on the antigen presenting cell and CD40 ligand on the T cell. This interaction results in upregulation of the B7 costimulator molecules (Roy, M. et al., *Eur. J. Immunol.* 25:596603 (1995)). In the presence of antiCD40 ligand antibody either in vivo or in vitro, the interaction with CD40 is blocked, B7 costimulator is not up regulated, and stimulation with a specific antigenic complex results in T cell tolerance rather than T cell immunity (Bluestone, J. A. et al., *Immunol. Rev.* 165:512 (1998)). Various protocols to block either or both CD40/CD40 ligand interactions and B7/CD28 interactions have been shown to effectively induce transplantation tolerance (Larsen, C. et al., *Nature* 381:434-438 (1996); Kirk et al., *Nature Medicine* 5:686693 (1999)). An example of the effect of antiCD40 ligand antibody (antiCD154) in blocking the reactivity of murine T cells to specific transplantation antigens is shown in FIGS. 17A and 17B. DBA/2 ($H2^d$) mice were immunized with $10^7$ C57Bl/6 ($H2^b$) spleen cells intraperitoneally and, in addition, were injected with either saline or 0.5 mg monoclonal antiCD40 ligand antibody (MR1, antiCD154, Pharmingen 09021D) administered both at the time of immunization and two days later. On day 10 following immunization, spleen cells from these mice were removed and stimulated in vitro with either C57Bl/6 or control allogeneic C3H($H2^k$) spleen cells that had been irradiated (20 Gy). After 5 days in vitro stimulation, C57Bl/6 and C3H specific cytolytic responses were assayed at various effector:target ratios by $^{51}Cr$ release assay from specific labeled targets, in this case, either C3H or C57Bl/6 dendritic cells pulsed with syngeneic spleen cell lysates. The results in FIGS. 17A and 17B show that significant cytotoxicity was induced against the control C3H alloantigens in both saline and antiCD154 treated mice whereas a cytotoxic response to C57Bl/6 was induced in the saline treated mice but not the antiCD154 treated mice. This demonstrates specific tolerance induction to the antigen employed for immune stimulation at the time CD40/CD40 ligand interactions were blocked by antiCD154.

A tolerization protocol similar to the above employing either antiCD154 alone or a combination of antiCD154 and antiB7 or antiCD28 could be employed to induce tolerance to normal human xenoantigens in mice prior to immunization with a human tumor. In one embodiment, the normal antigens would be expressed on immortalized normal cells derived from the same individual and tissue from which a tumor cell line is derived. In another embodiment, the normal and tumor antigens would derive from cell lysates of normal and tumor tissue of the same individual each lysate pulsed onto antigen presenting cells for presentation to syngeneic murine T cells both in vivo and in vitro. In a preferred embodiment, the tumors would derive by in vitro mutagenesis or oncogene transformation from an immortalized, contactinhibited, anchoragedependent, nontumorigenic cell line so that very wellmatched nontumorigenic cells would be available for tolerance induction.

An alternative to the tolerization protocols is depletion of T cells that are activated by normal antigens prior to immunization with tumor. Activated T cells transiently express CD69 and CD25 with peak expression between 24 and 48 hours poststimulation. T cells expressing these markers following activation with normal cells or normal cell lysates can be depleted with antiCD69 and antiCD25 antibody coupled directly or indirectly to a matrix such as magnetic beads. Subsequent immunization of the remaining T cells with tumor cells or tumor cell lysates either in vitro or in vivo following adoptive transfer will preferentially give rise to a tumorspecific response.

In one embodiment, the mice to be tolerized to normal human cells or lysates and subsequently immunized with tumor cells or lysates are any of a variety of commercially available inbred and outbred strains. Because murine T cells are restricted to recognize peptide antigens in association with murine MHC molecules which are not expressed by human cells, effective tolerization or stimulation requires either transfection of human cells with murine MHC molecules or representation of human normal and tumor antigens by mouse antigen presenting cells. Dendritic cells are especially preferred as antigen presenting cells because of their ability to represent antigenic peptides in both the class I and class II MHC pathways (Huang, et al., *Science* 264:961965 (1994); Inaba, et al., *J. Exp. Med.* 176:1702 (1992); Inaba, et al., *J. Exp. Med.* 178:479-488 (1993)). In another embodiment, mice double transgenic for human HLA and human CD8 or CD4 are employed. The HLA transgene permits selection of a high affinity, HLArestricted T cell repertoire in the mouse thymus. In addition, a human CD8 or CD4 transgene is required because murine CD8 and CD4 do not interact efficiently with the cognate human class I or class II MHC molecules. The use of nontransgenic mice to generate human tumorspecific T cells would lead to identification of any human tumor antigens that can be processed in association with murine MHC molecules. Since multiple murine strains with diverse MHC molecules are available, this could encompass a wide range of antigens. However, it would have to be separately determined by stimulation of human T cells with autologous antigen presenting cells whether these tumorspecific antigens also express peptides that can be processed and presented in association with human HLA. Such peptides may or may not overlap with those initially detected in association with murine MHC molecules but would derive from the same set of proteins. By employing HLA transgenic mice it is possible to more directly address the relevance of antigenic peptides to human MHC. There can, however, be no assurance that peptide processing will be identical in murine and human antigen presenting cells. It is essential, therefore, to confirm that HLArestricted, human tumor antigenspecific T cells are indeed also crossreactive on human tumor cells. Finally, no matter how the issue of processing and presentation in association with human HLA is addressed, it must in all cases be determined whether human T cells are reactive to the identified antigens or whether they have been rendered tolerant, perhaps due to expression of the same or a related antigen in some other nonhomologous normal tissue. Relevant information on this point can be obtained through in vitro stimulation of human T cell responses with the identified antigens or antigenic peptides presented by autologous antigen presenting cells. Ideally, it would be shown that patients with antigen positive tumors have an increased frequency of T cells reactive with the purported tumorspecific antigen. To demonstrate that the antigenspecific human T cells induced can be effective in eradicating tumors, the selected human T cells could be adoptively transferred into SCID mice bearing a human tumor xenograft as described by Renner, C. et al., *Science* 264:833835 (1994). However, definitive evidence for clinical relevance would await the results of a human clinical trial.

Conditions for in vitro stimulation of primary human T cell responses are described in Example 2 and are applicable to both CD4+ and CD8+ responses. The strategies described for induction of human T cell or antibody responses specific for human tumors are equally applicable to induction of T cell or antibody responses to target antigens of human cells infected with either a virus, fungus or mycobacteria. Indeed, in this case the same uninfected cell population affords an immediately available normal control population for tolerance induction and to confirm infectious specificity.

The construction of transgenic mice is well known in the art and is described, for example, in *Manipulating the Mouse Embroy: A laboratory Manual*, Hogan, et al., Cold Spring Harbor Press, second edition (1994). Human CD8 transgenic mice may be constructed by the method of LaFace, et al., *J. Exp. Med.* 182:131525 (1995). Construction of new lines of transgenic mice expressing the human CD8alpha and CD8beta subunits may be made by insertion of the corresponding human cDNA into a human CD2 minigene based vector for T cellspecific expression in transgenic mice (Zhumabekov, et al., *J. Immunol. Methods* 185:133140 (1995)). HLA class I transgenic mice may be constructed by the methods of Chamberlain, et al., *Proc. Natl. Acad. Sci. USA* 85:76907694 (1988) or Bernhard, et al., *J. Exp. Med.* 168:11571162 (1988) or Vitiello, et al., *J. Exp. Med.* 173: 10071015 (1991) or Barra, et al., *J. Immunol.* 150:36813689 (1993).

Construction of additional HLA class I transgenic mice may be achieved by construction of an H2Kb cassette that includes 2 kb of upstream regulatory region together with the first two introns previously implicated in gene regulation (Kralova, et al., 1992, EMBO J. 11: 45914600). Endogenous translational start sites are eliminated from this region and restriction sites for insertion of HLA cDNA are introduced into the third exon followed by a polyA addition site. By including an additional 3 kb of genomic H2Kb sequence at the 3' end of this construct, the class I gene can be targeted for homologous recombination at the H2Kb locus in embryonic stem cells. This has the advantage that the transgene is likely to be expressed at a defined locus known to be compatible with murine class I expression and that these mice are likely to be deficient for possible competition by H2Kb expression at the cell membrane. It is believed that this will give relatively reproducible expression of diverse human HLA class I cDNA introduced in the same construct.

Example 7

Figure 18:
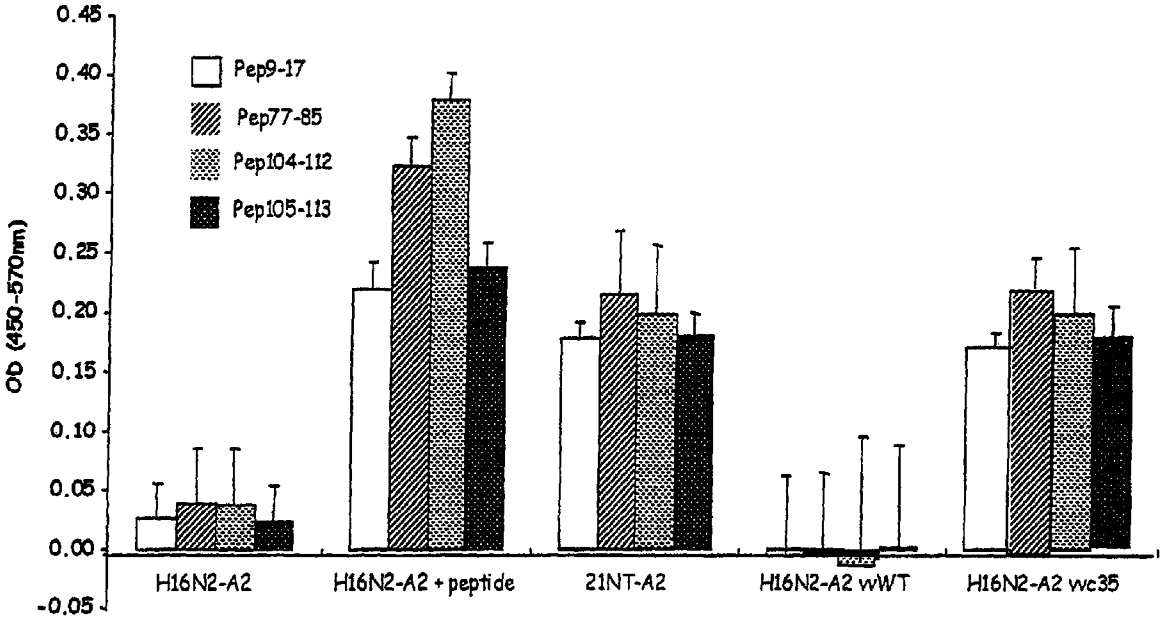
FIG. 18. GM-CSF Production by Line 4 After Stimulation with Native 21NT-A2 Tumor, H16N2-A2 Pulsed with Different C35 Peptides, or H16N2-A2 Infected with C35 Recombinant Vaccinia Virus. T cell line 4 was generated by stimulating normal donor T cells for 12 days each with autologous dendritic cells (DC) and then autologous monocytes infected with C35 recombinant vaccinia.virus. Weekly stimulation was continued with allo PBL and the 21NT tumor transfected with HLA-A2/Kb (21NT-A2). For the experiment depicted here, the T cells were restimulated in vitro at $10^6$ T cells per well with $5\times10^4$ irradiated (2500 rads) H16N2-A2/Kb pulsed with 1 ug/ml of C35 peptides 9-17, 77-85, 104-112, or 105-113 and $10^5$ irradiated allo PBL per well with IL2 (20 U/ml) and IL-7 (10 ng/ml) in AIM-V/5% human AB serum. After two (2) rounds of stimulation for 7 days, T cells were tested for induction of GM-CSF secretion following incubation with different stimulators pulsed or not pulsed with 1 ug/ml of peptide or infected with vvC35 or vvWT at MOI=1. T cells (5000) were incubated with 25000 of the various stimulator cells overnight in AIM-V/5% human AB serum in triplicate.

Induction of GM-CSF Secretion by Line 4 T Cells Stimulated with the C35 Peptide Epitopes T cell line 4 was generated by stimulating normal donor T cells for 12 days each with autologous dendritic cells (DC) and then autologous monocytes infected with C35 recombinant vaccinia.virus. Weekly stimulation was continued with allo PBL and the 21NT tumor transfected with HLA-A2/Kb (21NT-A2). The results of the experiment are depicted in FIG. 18. For this experiment, T cells were restimulated in vitro at $10^6$ T cells per well with $5\times10^4$ irradiated (2500 rads) H16N2-A2/Kb pulsed with 1 ug/ml of C35 peptides 9-17, 77-85, 104-112, or 105-113 and 105 irradiated allo PBL per well with IL2 (20 U/ml) and IL-7 (10 ng/ml) in AIM-V/5% human AB serum. After two (2) rounds of stimulation for 7 days, T cells were tested for induction of GM-CSF secretion following incubation with different stimulators pulsed or not pulsed with 1 ug/ml of peptide or infected with vvC35 or vvWT at MOI=1. T cells (5000) were incubated with 25000 of the various stimulator cells overnight in AIM-V/5% human AB serum in triplicate.

As shown in FIG. 18, no GM-CSF stimulation was observed with normal breast epithelial cells transfected with HLA-A2/Kb (H16N2-A2). However, the same cells pulsed with the C35 peptides produced significant stimulation (A16N2-A2+peptide). Stimulation was seen for cells pulsed with each peptide, with peptide 77-85 showing the greatest stimulation. In addition, significant stimulation was seen with the 21NT tumor cells transfected with HLA-A2/Kb (21NT-A2) but not pulsed with C35 peptides, as well as normal breast epithelial cells transfected with HLA-A2/Kb and infected with C35 recombinant vaccinia virus (H16N2-A2 vvC35). As expected, no stimulation was seen with normal breast epithelial cells transected with HLA-A2/Kb and infected with wild-type vaccinia virus.

The fact that minimal stimulation was seen H16N2-A2 cells that were not pulsed with any of the C35 peptides yet substantial stimulation was seen with the same cells pulsed with peptides confirms that each of the C35 peptides tested associates with HLA2. Moreover, the fact that the 21NT-A2 tumor cells also showed stimulation even though they had not been pulsed with any C35 peptides confirms that the C35 peptides are produced (i.e., processed) by the tumor cells. Finally, the fact that stimulation was observed with the H16N2-A2 cells infected with C35 recombinant vaccinia virus confirms that the full-length C35 polypeptide introduced recombinantly is processed in the cells.

Example 8

Generation of Peptide Specific $CD8^+$ T Cells $CD8^+$ T Cell Selection

PBMCs were harvested using standard Ficoll-Hypaque separation of anti-coagulated human blood. Whole blood was diluted with HBSS (w/o $Ca^{2+}/Mg^{2+}$) 2:1, in 50 ml centrifuge tubes. 30 ml of blood was then layered over 12 ml ficoll. The blood was centrifuged at 18° C., 400×g for 30 minutes, with the brake off. The interface layer containing PBMC was removed and washed 2× with HBSS.

CD8 positive cells were selected via magnetic activated cell sorting (MACS) manufactured by Miltenyi Biotec, Auburn, Calif. Specifically, the PBMCs are pelleted and resuspended in 80 µl MACS buffer (degassed, ice-cold PBS pH 7.2, supplemented with 0.5% BSA and 2 mM EDTA) per $10^7$ total cells. 20 µl of MACS CD8 microbeads was added per $10^7$ cells, mixed well and incubated for 15 minutes at 6-12° C. The cells were then washed by adding 12 ml MACS buffer, centrifuged at 300×g for 10 minutes at 4° C., the supernatant removed completely and the pellet resuspended in 1-2 ml MACS buffer. A positive selection $VS^+$ MACS column was placed in the magnetic field of a separator. The column was prepared by washing with 3 ml MACS buffer. The cell suspension was applied to the column, allowing the cells to completely enter the column. The column was then rinsed with 3×3 ml MACS buffer.

The column was removed from the separator and placed in a collection tube. 5 ml of MACS buffer was then pipetted onto the column and the cells firmly flushed through with supplied plunger. The $CD8^+$ cell type was verified via flow cytometry. The cells were either kept in culture in AIM-V media (Gibco, Carlsbad, Calif.) with 10% human AB serum (Gemini Bioproducts, Woodland, Calif.) or frozen in 10% DMSO & 90% human AB serum at −80° C. for later use.

Generation & Maturation of Dendritic Cells (DCs)

DC Selection from PBMCs

The PBMCs were plated out, either inclusive of all PBL or following $CD8^+$ and/or $CD4^+$ cell selection. $CD4^+$ cells were selected in the same manner as the $CD8^+$ cells (above) using Miltenyi Biotec MACS CD4 microbeads. The absence or presence of PBL does not make a difference in DC selection. PBMCs were then plated at $5\text{-}7\times10^6$ cells/well in 6-well plates in RPMI serum free media for 2 hrs at 37° C. Non-adherent cells were removed and the adherent layer washed with 3× with HBSS. Adherent cells were incubated in STEM-SPAN™ (StemCell Technologies, Vancouver, BC, Canada) with 1% human AB serum, 1000 U/ml GM-CSF and 1000 U/ml IL-4 at 37° C., 7% $CO_2$ for 7 days for generation of immature Dcs. Media and cytokines were replenished every other day.

DC Maturation

On day 7 immature DCs were collected by harvesting the non-adherent cells. The DCs were incubated in STEM-SPAN™ with 1% human AB serum, 1000 U/ml GM-CSF, 1000 U/ml IL-4, 10 ng/ml TNFα and 1 μg/ml CD40L for 24-48 hrs, 37° C., 7% $CO_2$, to mature.

$CD8^+$ Cell Stimulations with Peptide Pulsed APCs

A first stimulation was performed utilizing peptide pulsed autologous Dcs. The $CD8^+$ cells used were either fresh or brought back into culture from −80° a minimum of 24 hr prior to the stimulation. Fresh matured DCs were plated at $1\times10^4$ cells per well of 96-well U-bottom plate in AIM-V media. 10 μg/ml peptide and 3 μg/ml $\beta_2$-microglobulin were added to individual wells for a 4 hr pulse, 37° C., 7% $CO_2$.

Wells were combined for pools of peptide pulsed DCs where indicated. Cells were then transferred to 15 ml conical tubes, and the volume brought up to 12 ml with AIM-V media. The pellet was centrifuged and resuspended in AIM-V media and irradiated at 2500 rads. On Day 0, $1\times10^5$ peptide pulsed DCs were added to $2\times10^6$ $CD8^+$ cells in 24-well plates at a ratio of 20 T-cells to 1 DC for stimulations. The cells were maintained in AIM-V with 5% human AB serum and 10 ng/ml IL-7. On Day 1, 20 IU/ml IL-2 was added to each well. The wells were then incubated at 37° C., 7% $CO_2$ for 12 days, refreshing media when necessary.

$2^{nd}$ & $3^{rd}$ Stimulations

The protocol for the second and third stimulations was similar to the protocol for the $1^{st}$ stimulation with the following exceptions. Frozen DCs were utilized by bringing back into culture and maturing. The DCs were pulsed with 1-10 μg/ml peptide (experimentally dependent) for 2-4 hr. The DCs were irradiated at 2500 rads, omitting the washing step. Thus, any unbound peptide remained in media. The cells were maintained at a 20:1 ratio (CD8:DC) in 12 or 24-well plates, plating $1\times10^6$ $CD8^+$ cells/well. The T cells were assayed for target cell recognition via cytotoxicity and/or cytokine release assays 7-12 days post the $3^{rd}$ stimulation.

$4^{th}$ Stimulation and Beyond

Various cell types can be used as APCs, i.e., DC, monocytes, EBV-B and tumor. Autologous monocytes are given as an example. PBMCs are irradiated at 2500 rads, then plated out at $4\text{-}6\times10^6$ cells/well of 12-well plate in RPMI, and incubated for 2 hr at 37° C., 7% $CO_2$. Non-adherent cells are removed and the adherent monocytes washed 2× with HBSS.

The monocytes are then pulsed with peptides at 1-10 μg/ml in AIM-V media for 2 hours, 37° C., 7% $CO_2$. Where $CD8^+$ cells have previously been stimulated with peptide pulsed APCs in pools, combine peptides when pulsing monocytes into those same pools. Add 1-10 μg/ml of each peptide. $CD8^+$ cells are added to the respective pulsed monocytes, maintaining the 20:1 ratio.

On Day 0 10 ng/ml IL-7 are added, and on Day 1 20 IU/ml IL-2 are added. The cells are then incubate at 37° C., 7% $CO_2$, for 7 days refreshing media when necessary. In general, T cells are assayed for target cell recognition via cytotoxicity and/or cytokine release assays 5-7 days post each stimulation.

Clonal $CD8^+$ Cell Populations

Cells were cloned out by limiting dilution. To the wells of 96-well U-bottom plates were added: 1-10 $CD8^+$ cells, $1\times10^4$ mixed irradiated allogeneic feeder cells (2500 rads), 1000 peptide pulsed autologous irradiated EBV-B cells (2500 rads) and 10 ng/ml IL-7 in AIM-V media with 5% human AB serum. 20 IU/ml IL-2 was added on Day 1. Clones were refreshed weekly by changing 50% of the media, adding fresh cytokines and irradiated feeder and peptide pulsed B cells. Clones were selected for target cell recognition assays, cytotoxicity and/or cytokine release, and expansion, from plates showing <30% growth, indicating clonality of the limiting dilution.

Rapid Expansion Protocol

This protocol was utilized for clones showing lytic activity. (Protocol received from Dr. Steven Rosenberg (NCI) via personal communication.)

On Day 0, allogeneic mixed PBMC were irradiated (2500 rads) and added to a 25 $cm^2$ flask ($4\times10^7$ cells/flask) in 25 ml AIM-V with 10% human AB serum. OKT3 was added at 30 ng/ml followed by $1\times10^5$ viable cloned $CD8^+$ cells. On Day 2, IL-2 was added at 300 IU/ml. On Day 5, 20 ml media changed/flask, 300 IU/ml fresh IL-2 was added. Immune activity was tested for by cytotoxicity or cytokine release assay 8-11 days after REP.

Cytotoxicity $^{51}Cr$ Release Assay $CD8^+$ cells were screened for activity against selected target cells. APCs were pulsed with peptide and cells transduced to express retrovirus or vaccinia virus, tumor, normal controls, etc. Targets were washed by removing cells from flasks to 15 ml conical tubes, adding 12 mls HBSS, resuspending the cells and centrifuging down. The supernatant was then poured off ~200 μls. To this was added 100 uCi $^{51}Cr/1\times10^6$ cells. Targets were then incubated at 37° C., 7% $CO_2$ for 1 hr, then washed 2×12 ml HBSS.

Targets were resuspended in AIM-V with 5% human AB serum and added to wells of 96-well U-bottom plates. Next, 1-20 ug/ml of peptides was pulsed onto targets at various time points dependent on the experiment; overnight, prior to the addition of $^{51}Cr$ or following the $^{51}Cr$ incubation. $CD8^+$ effector cells were added in AIM-V with 5% human AB serum. E:T ratios ranging from 5:1 to 50:1. Samples were in triplicate, 200 μl final volume. Controls included spontaneous release of $^{51}Cr$ into the media, maximum release (incubation with 5% triton X100) and un-pulsed targets. The plates were spun at 700 RPM/5 minutes and incubated 4-6 hrs 37° C., 7% $CO_2$. The supernatant was harvested and $^{51}Cr$ release measured via gamma counter.

Cytokine ELISA Assays Measuring GM-CSF or γIFN Release

The Pharmingen (San Diego, Calif.) kits used may vary, need to follow manufacturer's instructions. In general, the protocol was as follows:

On Day 1, ELISA plates are coated with 100 μl diluted capture antibody per well in coating buffer (0.1M Carbonate, pH 9.5). The plates are then sealed and wrapped with foil and incubated overnight at 4° C. Targets are then incubated overnight with $CD8^+$ cells, in 96 well U-bottom plates, in AIM-V media with 5% human AB serum. Samples in triplicate.

On Day 2, the wells of the ELISA plates were aspirated and washed 3× (Bio-Tek plate washer, Winooski, Vt.) with 300 μl/well wash buffer (PBS, 0.05% TWEEN™ 20). The plates were then blocked with 200 μl/well assay diluent, incubated at room temp for 1 hr, and the plates washed 3× with wash buffer.

100 μl standards or culture supernatant from each unknown sample were added to their respective wells and incubated at room temp for 2 hrs.

Plates were washed 5× with wash buffer, 100 μl working detector added to each well, and the plates incubated at room temp for 1 hr. The plates were then washed 7× with wash buffer, 100 μl substrate solution added to each well, and the plates incubated for 15-30 min at room temp in dark. 50 μl 2N $H_2SO_4$ was added to each well to stop the reaction. The plates were then read at 450 nm within 30 minutes with λ correction 570 nm.

Example 9

C35 Peptide Mediated T Cell Lysis

T cell activity on EBV cells pulsed with C35 peptide epitopes was analyzed. Specifically, T cells obtained from two separate human donors expressing different HLA specificities were incubated with EBV-B target cells pulsed with C35 peptide epitopes. The results are shown in Table 10. The amino acid positions of the peptides in Table 10 refer to SEQ ID NO:2.

TABLE 10

T cell donor SB, HLA haplotype: A2, A3; B18, B44

| T cell clone | No peptide | % Lysis EBV-B cell-Target +p72-86 | % Lysis EBV-B cell-Target +p77-85 |
|---|---|---|---|
| #46 | 4.6 | 78.5 | 97.1 |

| T cell clone | No peptide | % Lysis EBV-B cell-Target +p17-31 | % Lysis EBV-B cell-Target +p22-30 |
|---|---|---|---|
| #72 | 0 | 0.5 | 72.8 |
| #75 | 1.6 | 1.2 | 56.8 |
| #104 | 0 | 6.4 | 100.3 |

peptide 17-31 VEPGSGVRIVVEYAE
peptide 22-30 GVRIVVEYA
peptide 72-86 QLVFSKLENGGFPYE
peptide 77-85 KLENGGFPY T cell donor LE, HLA haplotype: A3, A66; B8, B41

| T cell clone | No peptide | % Lysis EBV-B cell-Target +p67-75 | % Lysis EBV-B cell-Target +p81-89 |
|---|---|---|---|
| A | 10.4 | 54.9 | |
| B | 3.2 | | 40.3 |

peptide 67-75 IEINGQLVF
peptide 81-89 GGFPYEKDL

T cell donor AH, HLA haplotype: A2, A11; B8, B35

See induction of GM-CSF secretion by Line 4 T cells stimulated with: peptides 9-17 (SVAPPPEEV); 77-85 (KLENGGFPY); 104-112 (KITNSRPPC); 105-113 (ITNSRPPCV)

As shown in TABLE 10, T cell clones from the donor expressing the A2, A3, B18, and B44 HLA haplotypes stimulated against the 15mer corresponding to amino acid residues 72-86 of C35 (SEQ ID NO:2) or the 9mer corresponding to amino acids 77-85 (of SEQ ID NO:2) showed minimal lytic activity on EBV-B target cells that had not been pulsed with either peptide. However, a high level of lytic activity was observed with the EBV-B cells pulsed with either peptide (78.5% and 97.1% for peptide 72-86 and peptide 77-85, respectively). Similarly, T cells from the same donor raised against the 9 mer corresponding to amino acids 22-30 of C35 (SEQ ID NO:2) did not lyse target cells not pulsed with the peptide, but were very active in lysing target cells pulsed with the peptide. Notably, however, target cells pulsed with the 15mer corresponding to amino acids 17-31 of C35 (SEQ ID NO:2) exhibited minimal lysis even though it contains the 9mer 22-30 (of SEQ ID NO:2). T cell clones from another donor expressing the A3, A66, B8 and B41 HLA haplotypes stimulated against the 9mers corresponding to amino acids 67-75 and 81-89 of C35 (SEQ ID NO:2) exhibited moderate lytic activity (54.9% and 40.3%, respectively) on EBV-B target cells pulsed with these peptides.

The high level of lytic activity observed with EBV-B cells pulsed with either the 9mer p77-85 (of SEQ ID NO:2) or the 15mer p72-86 (of SEQ ID NO:2) demonstrates that in some instances larger peptides comprising a C35 peptide epitope are effective in stimulating a T cell response similar to that achieved with the actual epitope. However, the fact that minimal lysis was observed with p17-31 even though it contained a C35 peptide epitope, p22-30 (of SEQ ID NO:2), that triggered significant lytic activity, demonstrates that this effect is not seen in every instance.

Example 10

Monoclonal Antibodies Specific for C35

Immunization Protocols:

In order to generate monoclonal antibodies specific for C35, BALB/cByJ mice were immunized using one of three methods.

1. A syngeneic mouse fibrosarcoma cell line, BCA34, was transduced to express human C35 by infecting cells with C35 recombinant retrovirus. Stable C35 expressing cells were selected for resistance to G418. Two million cells were injected per mouse, and spleens were removed 23 days later for fusion with NS1 mouse myeloma cells, employing methods well known to those practiced in the art.

2. Line1, a poorly immunogenic mouse small cell lung carcinoma, was transduced to express C35 as described above for BCA34. Mice were immunized with 20,000 cells, and spleens were removed 20 days later for fusion with NS1 mouse myeloma cells.

3. Mice received an intraperitoneal injection of 10 million pfu of a vaccinia virus recombinant for human C35, VV.hC35. Spleens were removed after 15 days for fusion with NS1 mouse myeloma cells.

Screening Hybridoma Clones by ELISA.

ELISA assay were used to screen antibodies secreted by 500-1000 hybridoma clones from each fusion for reactivity and specificity for C35. ELISA plates were coated with C35 protein or Beta galactosidase as a negative control. Both proteins were generated and purified from *E. coli* in a similar fashion, including cleavage of selection tags. Supernatants from hybridoma clones were then incubated on the coated plates, followed by incubation with anti-mouse antibodies labeled with horseradish peroxidase (HRP), and detection with OPD substrate. Clones that reacted strongly with C35 protein but did not react with β-galactosidase were selected for further characterization. Each selected hybridoma clone was subcloned several times to develop a stable antibody-producing cell line. Table 11 lists the clones with confirmed specificity for C35. In several cases, antibody specificity was confirmed by Western blot of a C35 protein gel or by immunohistochemical staining as described below. Immunoglobulin heavy and light chain genes were cloned and sequenced from three C35 specific hybridomas of which two were determined to be identical.

TABLE 11

Hybridoma clones with demonstrated specificity for C35

| CLONE | Immunization | Isotype | Reactivity | Variable region genes |
|---|---|---|---|---|
| 1B2 | BCA34.hC35 | IgM | | |
| 1B3* | BCA34.hC35 | IgG1 | Western | |
| 1E 11 | BCA34.hC35 | IgG1 | | cloned (same as 1F2) |
| 1F2 | BCA34.hC35 | IgG1 | Western, IHC | cloned (same as 1E11) |
| 3E 9 | BCA34.hC35 | | | |
| 3E 10* | BCA34.hC35 | IgG1 | Western | |
| KC5 | Line1.hC35 | IgM | | |
| 11B10 | VV.hC35 | IgM | Western | cloned |

*antibody 1B3 is identical in sequence to antibody 3E10

Figure 19:
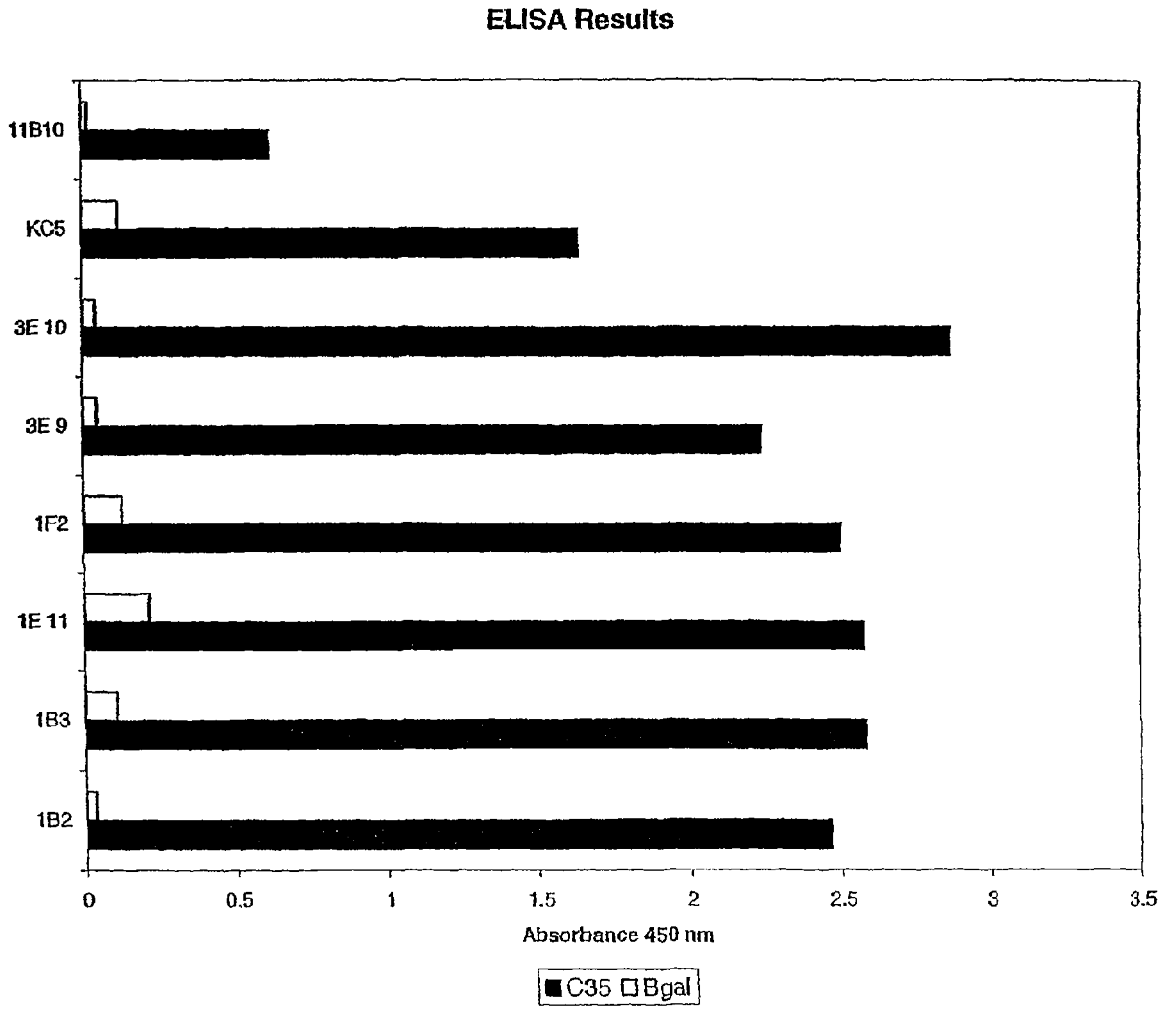
FIG. 19. C35-Specific ELISA of Hybridoma Supernatants. Results of a representative ELISA experiment involving hybridoma clones with demonstrated specificity for C35.

FIG. 19 shows a representative ELISA experiment. All clones were tested in triplicate on at least 3 separate occasions.

III. Western Blot Immunodetection

Figure 20:
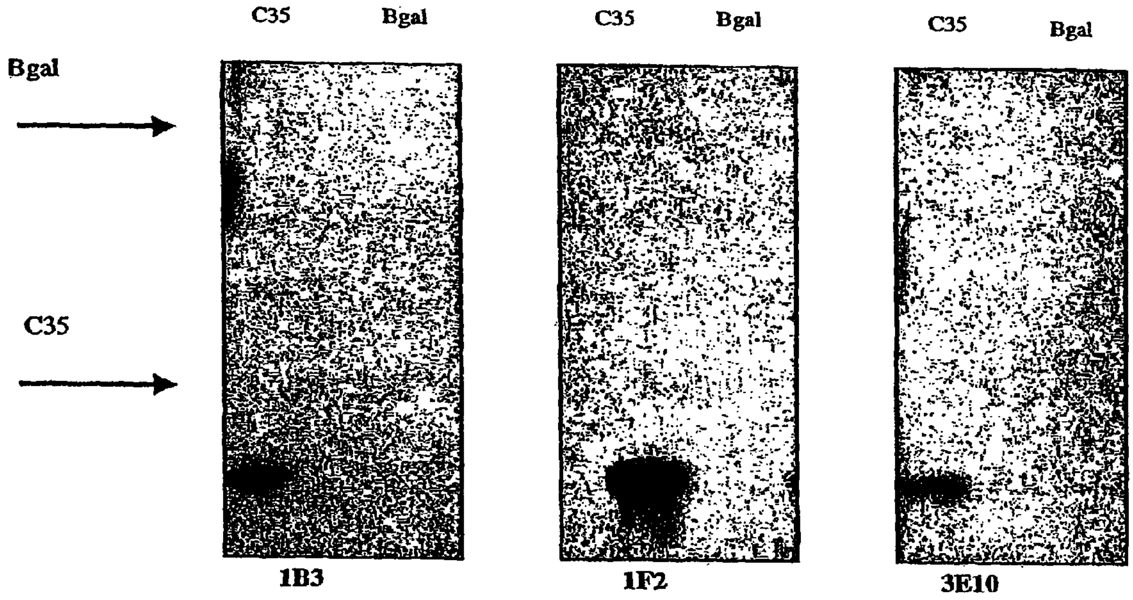
FIG. 20. Western Blot with C35-Specific Antibodies. Western Blot Immunodetection was performed with supernatant from selected hybridoma clones. Antibodies from 4 hybridomas (1B3, 1F2, 3E10, 11B10) reacted specifically with hC35 protein in this assay. Results for antibodies 1B3, 1F2, and 3E10 are shown.

Western Blot Immunodetection was performed with supernatants from selected hybridoma clones. Antibodies from 4 hybridomas (1B3, 1F2, 3E10, 11B10) reacted specifically with hC35 protein in this assay. In these experiments, 100 ng of purified recombinant C35 protein or control β-galactosidase protein was loaded in each lane of an 18% SDS polyacrylamide gel. Gels were transferred to PVDF membrane, as is well known to those practiced in the art. Membranes were blocked with Tris buffered saline (TBS), including Tween-20 and 5% non-fat dry milk. Each blot was incubated with various dilutions of hybridoma supernatants as the primary antibody, followed by incubation with a secondary antibody, goat anti-mouse IgG conjugated to HRP, and detected with the chemiluminescent substrate, ECL. Results for antibodies 1B3, 1F2, and 3E10 are shown in FIG. 20. Similar results were obtained with 11B10 (not shown).

IV. Immunohistochemistry.

Figure 21:
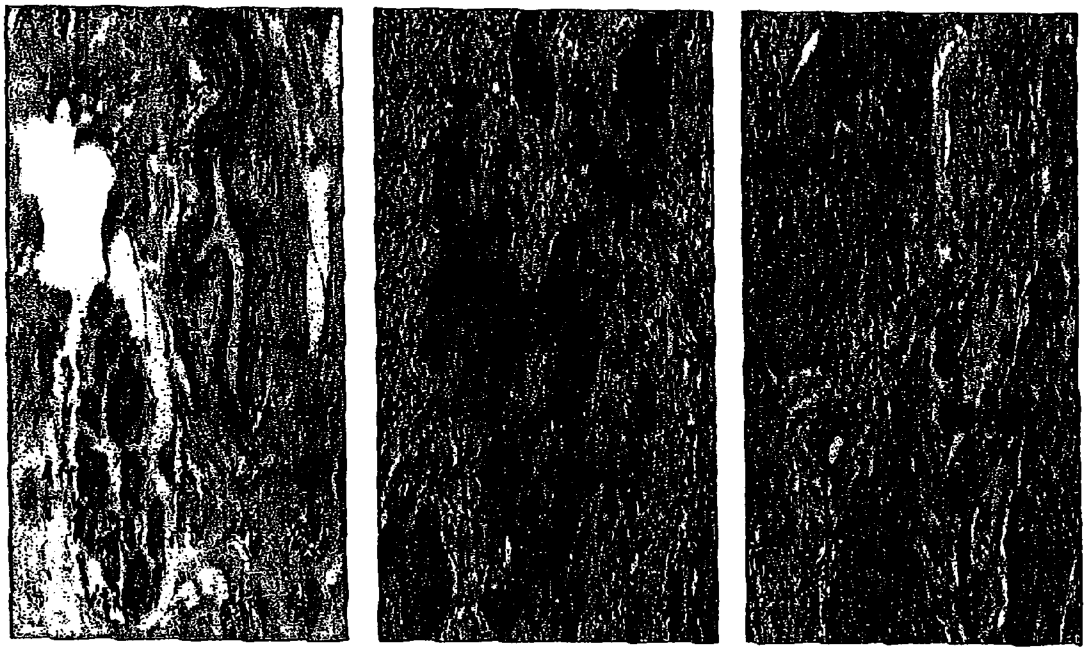
FIG. 21. Immunohistochemistry with 1F2 Antibody. Monoclonal antibody 1F2 was shown to have utility for immunohistochemical staining of primary breast tumor sections. This Figure demonstrates that monoclonal antibody 1F2 can detect high levels of endogenous C35 expression in human breast tumors, with little or no staining of normal breast tissue. Specifically, this Figure shows strong staining of a section of invasive breast adenocarcinoma from patient 01A6, while normal breast tissue from the same patient is negative.

ELISA and Western Blot data show that these monoclonal antibodies react with recombinant C35 protein. In addition, monoclonal antibody 1F2 was shown to have utility for immunohistochemical staining of primary breast tumor sections. FIG. 21 demonstrates that monoclonal antibody 1F2 can detect high levels of endogenous C35 expression in human breast tumors, with little or no staining of normal breast tissue. Antibody was affinity purified from 1F2 hybridoma supernatant. Paraffin-embedded slides were deparaffinized with xylene and rehydrated through graded alcohols. Target retrieval was achieved through steam and high pH treatment. Sections were blocked with normal serum, incubated with affinity purified 1F2 (5 mg/ml), followed by Vector ABC universal detection kit and development with DAB substrate. Slides were counterstained with hematoxylin, dehydrated with EtOH/xylene, and coverslipped.

FIG. 21 demonstrates strong staining of a section of invasive breast adenocarcinoma from patient 01A6, while normal breast tissue from the same patient is negative. Staining with the antibody could be competed with soluble C35 protein, but not with the irrelevant protein β-galactosidase (data not shown), this demonstrates that staining is specific for C35.

V. Cloning Variable Region Genes of Monoclonal Antibodies

Once specificity of individual clones was confirmed, cell pellets of the hybridoma clones and the fusion partner NS1 were snap frozen at −80° C. for later cloning of variable region genes. RNA was extracted from the cell pellets and full-length cDNA was generated using Invitrogen's GENERACER™ Kit. Briefly, the 5' end of the RNA is decapped, then ligated to GENERACER™ 5' oligo. Reverse strand cDNA is generated using oligo-dT primers and reverse transcriptase. Double stranded cDNA was amplified by PCR using gene racer oligo as the 5' primer and a 3' primer designed from a conserved sequence in the IgG1 constant region. PCR products were cloned and sequenced. Clones were identified that had unique sequences when compared to those of the fusion partner. The sequences were submitted to IgBLAST on the NCBI database to map the variable region framework and complementarity determining regions (CDR). To confirm that these V-genes are specific for C35, recombinant antibodies encoding these sequences have been generated and expressed in vitro and assayed by ELISA and Western (data not shown).

The sequences of two unique monoclonal antibody V-genes are shown below. Clones 1F2 and 1E11 have identical V-genes. Bold indicates CDR regions. Underline indicates framework regions. 1E11/1F2 Kappa and IgG1 V-genes (SEQ ID NOs:148 and 149); 3E10 Kappa and IgG1 V-genes (SEQ ID NOs:150 and 151).

1E11/1F2 V-genes:

Kappa

*atg*gattttcaggtgcagattttcagcttcctgctaatcagtgcctcagtcagaatgtccagaggacaaattgttctc acccagtctccagcaatcatgtctgcatctccaggggagaaggtcaccatatcctgcagtgccagctcaagtgt aagttacatgaactggtaccagcagaagccaggatcctcccccaaaccctggatttatcacacatccaacct ggcttctggagtccctgctcgcttcagtggcagtgggtctgggacctcttactctctcacaatcagcagcatgga ggctgaagatgctgccacttattactgccaacagtatcatagttacccacccacgttcggaggggggaccaa gctggaaataaaa IgG1

*atg*aaagtgttgagtctgttgtacctgttgacagccattcctggtatcctgtctgatgtacagcttcaggagtcagg acctggcctcgtgaaaccttctcagtctctgtctctcacctgctctgtcactggctactccatcaccagtggttattt

-continued
ctggaactggatccggcagtttccagggaacaaactggaatggatgggctacataagctacgacggtagca ataactccaacccatctctcaaaaatcgaatctccttcactcgtgacacatctaagaaccagttttcctgaagtt taattctgtgactactgacgactcagctgcatattactgtacaagaggaactacggggtttgcttactggggcca agggactctggtcactgtctctgca 3E10 V-genes:
KAPPA
Atgaggttccaggttcaggttctggggctccttctgctctggatatcaggtgcccactgtgatgtccagataaccc agtctccatcttttcttgctgcatctcctggagaaaccattactattaattgcagggcaagtaagtacattagcaa acatttagtctggtatcaggagaaacctggagaaactaaaaagcttcttatctactctggatccactttgcaatc tggacttccatcaaggttcagtggcagtggatctggtacagatttcactctcaccatcagtagcctggagcctgaa gattttgcaatgtattactgtcaacagcataatgaatacccgctcacgttcggtgctgggaccaagctggagct gaaa IgG1
atgatggtgttaagtcttctgtacctgttgacagcccttccgggtatcctgtcagaggtgcagcttcaggagtcag gacctagcctcgtgaaaccttctcagactctgtccctcacctgttctgtcactggcgactccatcaccagtggtta ctggaactggatccggaaattcccaggaaataaacttgaatacgtggggtacataagctacagtggtggcac ttactacaatccatctctcaaaagtcgaatctccatcactcgagacacatccaagaaccactactacctgcagt tgaattctgtgactactgaggacacagccacatattactgtgcaagaggtgcttactacgggggggccttttttc cttacttcgatgtctggggcgctgggaccacggtcaccgtctcctca

C35 is an Oncogene for Normal Breast Epithelial Cells

C35 is a gene of unknown function that we have previously shown is overexpressed in a large fraction of human breast and bladder tumors. Antibody to C35 inhibits growth of C35 positive tumor cells in vitro. This suggests that the C35 gene product may play a role in signal transduction on the tumor cell membrane and raises the possibility that C35 is an oncogene. Growth of colonies in soft agar is an accepted measure of anchorage independence, a property that distinguishes cells that have undergone tumor transformation from normal cells. In order to assay the oncogenic activity of C35, a line of immortalized, non-tumorigenic breast epithelial cells (H16N2) was transected with pTag.hC35 recombinant for the full length C35 gene, with empty pTag vector alone (pCMV-tag mammalian expression vector, Stratagene Corporation, LaJolla, Calif.) or with ras, a known oncogene. Formation of colonies in soft agar, indicative of transformation, was assessed and compared to 21-MT1 breast tumor cells (see Table 12 below). The results show a factor of 10 increase in the number of soft agar colonies formed following transfection with C35. This is comparable to the frequency of colonies formed following transfection with ras or that result when the 21-MT1 tumor line is plated in soft agar.

Transformed colonies were picked from soft agar and it was attempted to propagate them in liquid medium in 24-well plates. The small number of apparent colonies recovered following transfection with the vector control could not be successfully propagated in liquid culture. In contrast, colonies recovered following transfection with C35 or with ras have been successfully established as cell lines. It appears that even the small number of control colonies recovered from soft agar represent abortive growth.

TABLE 12

C35 Transforms Human Breast Epithelial Cells

| Cell Line | # of colonies | Propagated? |
|---|---|---|
| H16N2.pTag (vector control) | 14 | No |
| H16N2.pTag-hC35 | 150 | Yes |
| H16N2.ras (positive control) | 250 | Yes |
| 21-MT1 (metastatic tumor line, C35+) | 94 | Yes |

The fact that C35 appears to contribute to the transformed phenotype of tumor cells enhances the potential utility of a C35-based cancer vaccine or C35-specific antibodies as therapeutic agents for breast and bladder cancer. Immune evasion by down regulation of C35 gene expression in tumor cells or down regulation of C35 expression at the tumor surface membrane is less likely to be an obstacle to successful C35-based immunotherapy if the C35 gene product is required to maintain the tumor phenotype.

Example 12

Fluorescence Polarization to Monitor Mhc-Peptide Interactions in Solution

Fluorescence is characterized by a process of absorption of incident radiation at one wavelength, followed by the emission of radiation at another wavelength. This behavior was first described by G. G. Stokes (1852) in the form of Stokes' Law of Fluorescence in which he stated that fluorescence (emission) always appears at a wavelength greater than the wavelength of the incident (excitation) radiation.

This behavior was successfully explained by A. Einstein (1905) using Planck's quantum hypothesis. A quantum of incident light with an energy of $E_{excit}$ is absorbed by the fluorescent molecule raising its energy to $E_{excit}$. This is quickly followed by a downward transition of the molecule to one of the vibration levels in the ground state, $E_{emiss}$, with the emission of a quantum of light.

By using a fluorescent dye to label a small molecule, its binding to another molecule of equal or greater size can be monitored using fluorescence polarization (FP). FP operates on the principle that small molecules rotate faster than large molecules. If a molecule is labeled with a fluorophore, this rotation can be measured by exciting the fluorophore with plane polarized light and then measuring the emitted light with polarizers parallel and perpendicular to the plane of excitation to determine if it is still oriented in the same plane as it was when excited. If a fluorophore is labeled on a small molecule it will rotate in the time between excitation and emission and the light emitted will be depolarized. If the labeled molecule binds to a large molecule (effectively increasing its overall size) the molecule will not rotate in the time between excitation and emission, and the light emitted will be polarized resulting in a polarization change between the free and bound forms. For convenience, units are usually 1000 mP=P The kinetics of association between HLA-A*0201 and a specific fluorescent-labeled peptide was determined in the presence of a test competitor peptide at 100 μM. Binding increases over time until it plateaus when specific binding reaches equilibrium at Ymax. If the added test-competitor is able to compete, equilibrium will be reached faster but with less binding. Ymax can be used to calculate % inhibition if the system is calibrated with an irrelevant competitor (0%) and a relevant competitor (100%). In this case, the irrelevant competitor was the HLA-B*2705 binding (non-HLA-A*0201 binding) peptide GRAFVTIGK (SEQ ID NO:2128) while the relevant competitor was the known HLA-A*0201 binding peptide KLGEFYNQMM (SEQ ID NO:2129). To obtain Ymax, the curves are fitted to a mono-exponential association model using non-linear regression.

The following eight peptides (based on amino acid sequence of SEQ ID NO:2 were found to have High to Medium binding capacity to HLA-A*0201 as reflected by relative inhibition of binding of the relevant competitor.

| Peptide | % inhibition |
|---|---|
| S9 to V17 | 96.9 |
| I25 to A33 | 94.9 |
| S21 to Y29 | 90.8 |
| I105 to V113 | 86.4 |
| F65 to L73 | 74.8 |
| G22 to A30 | 67 |
| T38 to V46 | 47.3 |
| G61 to I69 | 46.5 |

A similar analysis was conducted with C35 peptides that bind to soluble HLA-B*0702 employing a fluorescent labeled HLA-B*0702 binding standard and suitable relevant and irrelevant peptides to calibrate inhibition of binding by test peptides. Note that these inhibition values are sensitive to the choice and concentration of both MHC molecule and specific fluorescent peptides under the same assay conditions. It is not meaningful, however, to compare HLA-A*0201 and HLA-B*0702 inhibition values. As shown below, six C35-derived peptides nine amino acids in length were found to have high or medium relative binding affinity to HLA-B*0702.

| Peptide % | Inhibition | |
|---|---|---|
| K104 to A112 | 69.4 | (analog with Ala substituted for Cys at 112) |
| N107 to L115 | 68.2 | (analog with Ala substituted for Cys at 112) |
| E4 to P12 | 54.6 | |
| G63 to G71 | 51.4 | |
| I105 to V113 | 45.2 | (analog with Ala substituted for Cys at 112) |
| T62 to N70 | 38.8 | |

Example 13

Construction of NTerminal and/or CTerminal Deletion Mutants

The following general approach may be used to clone a Nterminal or Cterminal deletion C35 deletion mutant. Generally, two oligonucleotide primers of about 1525 nucleotides are derived from the desired 5' and 3' positions of a polynucleotide of SEQ ID NO: 1. The 5' and 3' positions of the primers are determined based on the desired C35 polynucleotide fragment. An initiation and stop codon are added to the 5' and 3' primers respectively, if necessary, to express the C35 polypeptide fragment encoded by the polynucleotide fragment. Preferred C35 polynucleotide fragments are those encoding the candidate MHC class I and MHC class II binding peptides disclosed above in the "Polynucleotide and Polypeptide Fragments" section of the Specification.

Additional nucleotides containing restriction sites to facilitate cloning of the C35 polynucleotide fragment in a desired vector may also be added to the 5' and 3' primer sequences. The C35 polynucleotide fragment is amplified from genomic DNA or from the cDNA clone using the appropriate PCR oligonucleotide primers and conditions discussed herein or known in the art. The C35 polypeptide fragments encoded by the C35 polynucleotide fragments of the present invention may be expressed and purified in the same general manner as the full length polypeptides, although routine modifications may be necessary due to the differences in chemical and physical properties between a particular fragment and full length polypeptide.

As a means of exemplifying but not limiting the present invention, the polynucleotide encoding the C35 polypeptide fragment is amplified and cloned as follows: A 5' primer is generated comprising a restriction enzyme site followed by an initiation codon in frame with the polynucleotide sequence encoding the Nterminal portion of an MHC binding peptide epitope listed in any of Tables 1 through 6. A complementary 3' primer is generated comprising a restriction enzyme site followed by a stop codon in frame with the polynucleotide sequence encoding Cterminal portion of a C35 MHC binding peptide epitope listed in any of Tables 1 through 6.

The amplified polynucleotide fragment and the expression vector are digested with restriction enzymes which recognize the sites in the primers. The digested polynucleotides are then ligated together. The C35 polynucleotide fragment is inserted into the restricted expression vector, preferably in a manner which places the C35 polypeptide fragment coding region downstream from the promoter. The ligation mixture is transformed into competent *E. coli* cells using standard procedures and as described in the Examples herein. Plasmid DNA is isolated from resistant colonies and the identity of the cloned DNA confirmed by restriction analysis, PCR and DNA sequencing.

Example 14

Protein Fusions of C35

C35 polypeptides are preferably fused to other proteins. These fusion proteins can be used for a variety of applications. For example, fusion of C35 polypeptides to Histag, HAtag, protein A, IgG domains, and maltose binding protein facilitates purification. (See Example 5; see also EP A 394, 827; Traunecker et al., *Nature* 331:8486 (1988).) Similarly, fusion to IgG1, IgG3, and albumin increases the halflife time in vivo. Nuclear localization signals fused to C35 polypeptides can target the protein to a specific subcellular localization, while covalent heterodimer or homodimers can increase or decrease the activity of a fusion protein. Fusion proteins can also create chimeric molecules having more than one function. Finally, fusion proteins can increase solubility and/or stability of the fused protein compared to the nonfused protein. All of the types of fusion proteins described above can be made by modifying the following protocol, which outlines the fusion of a polypeptide to an IgG molecule.

Briefly, the human Fc portion of the IgG molecule can be PCR amplified, using primers that span the 5' and 3' ends of the sequence described below. These primers also should have convenient restriction enzyme sites that will facilitate cloning into an expression vector, preferably a mammalian expression vector.

For example, if pC4 (Accession No. 209646) is used, the human Fc portion can be ligated into the BamHI cloning site. Note that the 3' BamHI site should be destroyed. Next, the vector containing the human Fc portion is rerestricted with BamHI, linearizing the vector, and C35 polynucleotide, isolated by the PCR protocol described in Example 1, is ligated into this BamHI site. Note that the C35 polynucleotide is cloned without a stop codon, otherwise a fusion protein will not be produced.

If the naturally occurring signal sequence is used to produce the secreted protein, pC4 does not need a second signal peptide. Alternatively, if the naturally occurring signal sequence is not used, the vector can be modified to include a heterologous signal sequence. (See, e.g., WO 96/34891.)

```
Human IgG Fc region:
                                        (SEQ ID NO: [84])
GGGATCCGGAGCCCAAATCTTCTGACAAAACTCACACATGCCCACCGT

GCCCAGCACCTGAATTCGAGGGTGCACCGTCAGTCTTCCTCTTCCCCC

CAAAACCCAAGGACACCCTCATGATCTCCCGGACTCCTGAGGTCACAT

GCGTGGGGTGGACGTAAGCCACGAAGACCCTGAGGTCAAGTTCAACTG

GTACGTGGCGGCGTGGAGGTGCATAATGCCAAGACAAAGCCGCGGGAG

GAGCAGTACACAGCACGTACCGTGTGGTCAGCGTCCTCACCGTCCTGC

ACCAGGACTGGTGAATGGCAAGGAGTACAAGTGCAAGGTCTCCAACAA

AGCCCTCCCAACCCCCATCGAGAAAACCATCTCCAAAGCCAAAGGGCA

GCCCCGAGAACCAAGGTGTACACCCTGCCCCCATCCCGGGATGAGCTG

ACCAAGAACCAGGTAGCCTGACCTGCCTGGTCAAAGGCTTCTATCCAA

GCGACATCGCCGTGGATGGGAGAGCAATGGGCAGCCGGAGAACAACTA

CAAGACCACGCCTCCCGGCTGGACTCCGACGGCTCCTTCTTCCTCTAC
```

-continued

```
AGCAAGCTCACCGTGGACAGAGCAGGTGGCAGCAGGGGAACGTCTTCT

CATGCTCCGTGATGCATGAGGTCTGCACAACCACTACACGCAGAAGAG

CCTCTCCCTGTCTCCGGGTAAATGAGTGCGACGGCCGCGACTCTAGAG

GAT
```

A preferred fusion product is fusion of a C35 peptide to the amino terminus of an MHC molecule in such fashion that the peptide will naturally occupy the MHC peptide binding groove. Kang, X. et al., Cancer Res. 57:2025 (1997) have reported that such fusion proteins can be employed in vaccine compositions that are especially effective for stimulation of specific T cells.

Example 15

Method of Detecting Abnormal Levels of C35 in a Biological Sample

C35 polypeptides can be detected in a biological sample, and if an increased or decreased level of C35 is detected, this polypeptide is a marker for a particular phenotype. Methods of detection are numerous, and thus, it is understood that one skilled in the art can modify the following assay to fit their particular needs.

For example, antibodysandwich ELISAs are used to detect C35 in a sample, preferably a biological sample. Wells of a microtiter plate are coated with specific antibodies to C35, at a final concentration of 0.2 to 10 ug/ml. The antibodies are either monoclonal or polyclonal. The wells are blocked so that nonspecific binding of C35 to the well is reduced.

The coated wells are then incubated for >2 hours at RT with a sample containing C35. Preferably, serial dilutions of the sample should be used to validate results. The plates are then washed three times with saline to remove unbounded C35.

Next, 50 ul of specific antibodyalkaline phosphatase conjugate that recognizes a C35 antigenic determinant which does not overlap with that recognized by the plate bound antibody, at a concentration of 25400 ng, is added and incubated for 2 hours at room temperature. The plates are again washed three times with deionized or distilled water to remove unbounded conjugate.

Add 75 ul of 4methylumbelliferyl phosphate (MUP) or p-nitrophenyl phosphate (NPP) substrate solution to each well and incubate 1 hour at room temperature. Measure the reaction by a microtiter plate reader. Prepare a standard curve, using serial dilutions of a control sample, and plot C35 polypeptide concentration on the Xaxis (log scale) and fluorescence or absorbance on the Yaxis (linear scale). Interpolate the concentration of the C35 in the sample using the standard curve.

Example 16

Formulating a Polypeptide

The C35 composition will be formulated and dosed in a fashion consistent with good medical practice, taking into account the clinical condition of the individual patient (especially the side effects of treatment with the C35 polypeptide alone), the site of delivery, the method of administration, the scheduling of administration, and other factors known to practitioners. The "effective amount" for purposes herein is thus determined by such considerations.

As a general proposition, the total pharmaceutically effective amount of C35 administered parenterally per dose will be in the range of about 1 ug/kg/day to 10 mg/kg/day of patient body weight, although, as noted above, this will be subject to therapeutic discretion. More preferably, this dose is at least 0.01 mg/kg/day, and most preferably for humans between about 0.01 and 1 mg/kg/day. If given continuously, C35 is typically administered at a dose rate of about 1 ug/kg/hour to about 50 ug/kg/hour, either by 14 injections per day or by continuous subcutaneous infusions, for example, using a minipump. An intravenous bag solution may also be employed. The length of treatment needed to observe changes and the interval following treatment for responses to occur appears to vary depending on the desired effect.

Pharmaceutical compositions containing C35 are administered orally, rectally, parenterally, intracistemally, intravaginally, intraperitoneally, topically (as by powders, ointments, gels, drops or transdermal patch), bucally, or as an oral or nasal spray. "Pharmaceutically acceptable carrier" refers to a nontoxic solid, semisolid or liquid filler, diluent, encapsulating material or formulation auxiliary of any type. The term "parenteral" as used herein refers to modes of administration which include intravenous, intramuscular, intraperitoneal, intrasternal, subcutaneous and intraarticular injection and infusion.

C35 is also suitably administered by sustainedrelease systems. Suitable examples of sustainedrelease compositions include semipermeable polymer matrices in the form of shaped articles, e.g., films, or microcapsules. Sustainedrelease matrices include polylactides (U.S. Pat. No. 3,773,919, EP 58,481), copolymers of Lglutamic acid and gammaethylLglutamate (Sidman, U. et al., *Biopolymers* 22:547556 (1983)), poly (2 hydroxyethyl methacrylate) (R. Langer et al., *J. Biomed. Mater. Res.* 15:167277 (1981), and R. Langer, *Chem. Tech.* 12:98105 (1982)), ethylene vinyl acetate (R. Langer et al.) or polyD( )3hydroxybutyric acid (EP 133,988). Sustainedrelease compositions also include liposomally entrapped C35 polypeptides. Liposomes containing the C35 are prepared by methods known per se: DE 3,218,121; Epstein et al., *Proc. Natl. Acad. Sci. USA* 82:36883692 (1985); Hwang et al., *Proc. Natl. Acad. Sci. USA* 77:40304034 (1980); EP 52,322; EP 36,676; EP 88,046; EP 143,949; EP 142,641; Japanese Pat. Appl. 83118008; U.S. Pat. Nos. 4,485,045 and 4,544,545; and EP 102,324. Ordinarily, the liposomes are of the small (about 200800 Angstroms) unilamellar type in which the lipid content is greater than about 30 mol. percent cholesterol, the selected proportion being adjusted for the optimal secreted polypeptide therapy.

For parenteral administration, in one embodiment, C35 is formulated generally by mixing it at the desired degree of purity, in a unit dosage injectable form (solution, suspension, or emulsion), with a pharmaceutically acceptable carrier, i.e., one that is nontoxic to recipients at the dosages and concentrations employed and is compatible with other ingredients of the formulation. For example, the formulation preferably does not include oxidizing agents and other compounds that are known to be deleterious to polypeptide.

Generally, the formulations are prepared by contacting C35 uniformly and intimately with liquid carriers or finely divided solid carriers or both. Then, if necessary, the product is shaped into the desired formulation. Preferably the carrier is a parenteral carrier, more preferably a solution that is isotonic with the blood of the recipient. Examples of such carrier vehicles include water, saline, Ringer's solution, and dextrose solution. Nonaqueous vehicles such as fixed oils and ethyl oleate are also useful herein, as well as liposomes.

The carrier suitably contains minor amounts of additives such as substances that enhance isotonicity and chemical stability. Such materials are nontoxic to recipients at the dosages and concentrations employed, and include buffers such as phosphate, citrate, succinate, acetic acid, and other organic acids or their salts; antioxidants such as ascorbic acid; low molecular weight (less than about ten residues) polypeptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, manose, or dextrins; chelating agents such as EDTA; sugar alcohols such as mannitol or sorbitol; counterions such as sodium; and/or nonionic surfactants such as polysorbates, poloxamers, or PEG.

C35 is typically formulated in such vehicles at a concentration of about 0.1 mg/ml to 100 mg/ml, preferably 110 mg/ml, at a pH of about 3 to 8. It will be understood that the use of certain of the foregoing excipients, carriers, or stabilizers will result in the formation of polypeptide salts.

C35 used for therapeutic administration can be sterile. Sterility is readily accomplished by filtration through sterile filtration membranes (e.g., 0.2 micron membranes). Therapeutic polypeptide compositions generally are placed into a container having a sterile access port, for example, an intravenous solution bag or vial having a stopper pierceable by a hypodermic injection needle.

C35 polypeptides ordinarily will be stored in unit or multidose containers, for example, sealed ampoules or vials, as an aqueous solution or as a lyophilized formulation for reconstitution. As an example of a lyophilized formulation, 10 ml vials are filled with 5 ml of sterilefiltered 1% (w/v) aqueous C35 polypeptide solution, and the resulting mixture is lyophilized. The infusion solution is prepared by reconstituting the lyophilized C35 polypeptide using bacteriostatic WaterforInjection.

The invention also provides a pharmaceutical pack or kit comprising one or more containers filled with one or more of the ingredients of the pharmaceutical compositions of the invention. Associated with such container(s) can be a notice in the form prescribed by a governmental agency regulating the manufacture, use or sale of pharmaceuticals or biological products, which notice reflects approval by the agency of manufacture, use or sale for human administration. In addition, C35 may be employed in conjunction with other therapeutic compounds.

Example 17

C35 Peptide Mediated Cell Lysis

T cell activity on various cell lines was analyzed. Specifically, T cells obtained from one human donor stimulated with peptide pulsed DCs were incubated with different cell line targets. The results are shown in Tables 13 and 14.

CD8+ cells were stimulated using DCs and pulsed autologous DCs as described in Example 8. DCs were pulsed with a K104-V113 peptide fragment of C35 (SEQ ID NO:2) with TCEP (K104-V113), a reducing agent to protect the cysteine contained in the peptide. DCs were also pulsed with a K104-V113 peptide fragment containing an alanine or serine substitution at amino acid position 112 (K104-V113-Ala (SEQ ID NO:176) and K104-V113-Ser (SEQ ID NO:178)). DCs were also pulsed with a K104-V113 peptide fragment of C35 containing a cysteinylated cysteine at amino acid position 112 (K104-V113-cys-cys (SEQ ID NO: 2130).

The target cells used in the experiment were as follows: a normal breast endothelial cell line which is HLA-A2 positive and has low levels of C35 expression (H16.A2); a breast tumor cell line which is HLA-A2 negative and has high levels of C35 expression (21NT); a breast tumor cell line which is HLA-A2 positive and has high levels of C35 expression (21NT.A2); a cell line which is sensitive to non-specific killing by NK cells (K562); a head and neck cancer cell line which is HLA-A2 positive and does not express C35 (PCl-13); and the PCl-13 cell line pulsed with a 104-113 peptide fragment of C35 with a serine substitution at amino acid position 112 (SEQ ID NO:178) (PCl-13 K104-V113-Ser).

Cell lysis was measured in a cytotoxicity 51Cr release assay as described in Example 8. Raw chromium values, as measured from the supernatant from target cells used in the experiments, are shown in Table 13. The spontaneous values are from target cells incubated in medium with no CD8+ cells added. The maximum values are from target cells incubated in HCl so that all cells are lysed. The percentage of cell lysed data is shown in Table 14. The peptides in Tables 13-16 have the following SEQ ID NOs: K104-V113-Ala (SEQ ID NO:176), K104-V113-Ser (SEQ ID NO:178), K104-V113-cys-cys (SEQ ID NO:2130), and K104-V113 (of SEQ ID NO:2).

TABLE 13

T cell donor SB, HLA haplotype: A2, A3; B18, B44
Raw Chromium Values

| In vitro Stimulus | H16.A2 | 21NT | 21NT.A2 | K562 | PCl-13 | PCl-13 K104-V113-Ser |
|---|---|---|---|---|---|---|
| DC | 466 | 177 | 732 | 453 | 691 | 673 |
| K104-V113-Ala | 479 | 155 | 763 | 246 | 468 | 746 |
| K104-V113-Ser | 584 | 185 | 3228 | 323 | 581 | 2588 |
| K104-V113-cys-cys | 440 | 171 | 1329 | 287 | 486 | 1772 |
| K104-V113 | 483 | 137 | 1429 | 311 | 804 | 1403 |
| Spontaneous | 425 | 173 | 440 | 267 | 543 | 538 |
| Maximum | 6628 | 2654 | 4853 | 2481 | 3962 | 4029 |
| % Spontaneous | 6.4 | 6.5 | 9.1 | 10.8 | 13.7 | 13.4 |

TABLE 14

T cell donor SB, HLA haplotype: A2, A3; B18, B44
Percentage of Target Cells Lysed

| In vitro Stimulus | H16.A2 | 21NT | 21NT.A2 | K562 | PCl-13 | Pcl-13 K104-V113-Ser |
|---|---|---|---|---|---|---|
| DC | 0.7 | 0.2 | 6.6 | 8.4 | 4.3 | 3.9 |
| K104-V113-Ala | 0.9 | −0.7 | 7.3 | −0.9 | −2.2 | 6.0 |
| K104-V113-Ser | 2.6 | 0.5 | 63.2 | 2.5 | 1.1 | 58.7 |
| K104-V113-cys-cys | 0.2 | −0.1 | 20.1 | 0.9 | −1.7 | 35.3 |
| K104-V113 | 0.9 | −1.5 | 22.4 | 2.0 | 7.6 | 24.8 |

The cytotoxicity 51Cr release assay was repeated with the same CD8+ cells which received in vitro stimulus using C35 peptides described above and in Example 8. In addition to the cell lines described above, the 21NT.A2 breast tumor cell line pulsed with a K104-V113 C35 peptide fragment containing a serine substitution at amino acid position 112 (21NT.A2-Ser (SEQ ID NO:178)) was used. Various melanoma cell lines were also used as target cells. Melanoma cell lines 1700 (Mel 1700), 501 (Mel 501) and F002 (Mel F002) are HLA-A2 positive and express C35. Melanoma cell line 1359 (Mel 1359) is HLA-A2 negative and expresses C35. The effector to target cell ratio was 30:1 for this experiment. CD8+ cells used in the experiment have been maintained in IL-2 for 12 days after the fourth stimulation. Raw chromium values, as measured from the supernatant from target cells used in the experiments, are shown in Table 15. The percentage of lysed cells is shown in Table 16.

TABLE 15

T cell donor SB, HLA haplotype: A2, A3; B18, B44
Raw Chromium Values

| In vitro Stimulus | H16.A2 | 21NT.A2 | 21NT.A2-Ser | K562 |
|---|---|---|---|---|
| DC | 916 | 2383 | 2470 | 1403 |
| K104-V113-Ala | 829 | 1365 | 2423 | 815 |
| K104-V113-Ser | 1018 | 4957 | 4762 | 974 |
| K104-V113-cys-cys | 1024 | 2337 | 4474 | 1713 |
| K104-V113 | 948 | 2753 | 3729 | 1156 |
| Spontaneous | 729 | 875 | 855 | 619 |
| Maximum | 5848 | 8521 | 7830 | 7356 |
| **In vitro Stimulus** | **Mel 1700** | **Mel 1359** | **Mel 501** | **Mel F002** |
| DC | 1743 | 2443 | 2470 | 1403 |
| K104-V113-Ala | 1543 | 3050 | 2423 | 815 |
| K104-V113-Ser | 2951 | 2357 | 4762 | 974 |
| K104-V113-cys-cys | 1857 | 2299 | 4474 | 1713 |

TABLE 15-continued

T cell donor SB, HLA haplotype: A2, A3; B18, B44
Raw Chromium Values

| | | | | |
|---|---|---|---|---|
| K104-V113 | 1964 | 2758 | 3729 | 1156 |
| Spontaneous | 1387 | 2050 | 1637 | 1716 |
| Maximum | 7887 | 12157 | 8953 | 8003 |

TABLE 16

| T cell donor SB, HLA haplotype: A2, A3; B18, B44 Percentage of Target Cells Lysed | | | | |
|---|---|---|---|---|
| In vitro Stimulus | H16.A2 | 21NT.A2 | 21NT.A2-Ser | K562 |
| DC | 3.7 | 19.7 | 23.2 | 11.6 |
| K104-V113-Ala | 2.0 | 6.4 | 22.5 | 2.9 |
| K104-V113-Ser | 5.6 | 53.4 | 56.0 | 5.3 |
| K104-V113-cys-cys | 5.8 | 19.1 | 51.9 | 16.2 |
| K104-V113 | 4.3 | 24.6 | 41.5 | 8.0 |
| In vitro Stimulus | Mel 1700 | Mel 1359 | Mel 501 | Mel F002 |
| DC | 5.5 | 3.9 | 15.8 | 11.5 |
| K104-V113-Ala | 2.4 | 9.9 | 11.1 | 7.6 |
| K104-V113-Ser | 24.1 | 3.0 | 45.3 | 15.1 |
| K104-V113-cys-cys | 7.2 | 2.5 | 21.2 | 11.2 |
| K104-V113 | 8.9 | 7.0 | 36.0 | 15.7 |

It will be clear that the invention may be practiced otherwise than as particularly described in the foregoing description and examples. Numerous modifications and variations of the present invention are possible in light of the above teachings and, therefore, within the scope of the appended claims, the invention may be practiced otherwise than as particularly described.

The entire disclosure of each document cited (including patents, patent applications, journal articles, abstracts, laboratory manuals, books, or other disclosures) in the Background of the Invention, Detailed Description, Examples, and Sequence Li sting is hereby incorporated herein by reference.

SEQUENCE LISTING (2146 sequences)

SEQ ID NO: 1 - DNA, 354 bp, Homo sapiens
  CDS (7)..(354)
gccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtga

SEQ ID NO: 2 - protein, 115 aa, Homo sapiens
MSGEPGQTSVAPPPEEVEPGSGVRIVVEYCEPCGFEATYLELASAVKEQYPGIEIESRLGGTGAFEIEINGQLVFSKLENGGFPYEKDLIEAIRRASNGETLEKITNSRPPCVIL

SEQ ID NO: 3 - DNA, 518 bp, Homo sapiens
gggccgcgatgagcgtagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctcccctgcctctttcacctacttagctccttagcaaagagacactggcctccactttgccctttgggtacaaagaaggaatagaagattccgt

SEQ ID NO: 4 - DNA, 621 bp, Homo sapiens
  misc_feature (14)..(15): n is any nucleotide of a, t, g or c
  misc_feature (24)..(24): n is any nucleotide of a, t, g or c
  misc_feature (28)..(28): n is any nucleotide of a, t, g or c
  misc_feature (31)..(31): n is any nucleotide of a, t, g or c
  misc_feature (33)..(33): n is any nucleotide of a, t, g or c
  misc_feature (491)..(491): n is any nucleotide of a, t, g or c
  misc_feature (535)..(535): n is any nucleotide of a, t, g or c
  misc_feature (557)..(557): n is any nucleotide of a, t, g or c
  misc_feature (565)..(565): n is any nucleotide of a, t, g or c
  misc_feature (574)..(574): n is any nucleotide of a, t, g or c
  misc_feature (588)..(588): n is any nucleotide of a, t, g or c
  misc_feature (595)..(595): n is any nucleotide of a, t, g or c
  misc_feature (606)...(606): n is any nucleotide of a, t, g or c
ggggcccgagcggnngccagcgantganggnangccgggacagacgtccgtagcgccccctcccgaggaggtcgagccgggcagtggggtccgcatcgtggtggagtactgtgaaccctgcggcttcgaggctacctacctggagctggccagtgctgtgaaggagcagtatccgggcatcgagatcgagtcgcgcctcgggggcacaggtgctttgagatagagataaatggacagctggtgttctccaagctggagaatgggggctttccctatgagaaagatctcattgaggccatccgaagagccagtaatggagaaaccctagaaaagatcaccaacaagcccgtcctcccttgcgtcatcctgtgacttgcacaggactctggggttcctgctctgttctgggggtccaaaccttggtctccctttggtcctgctgggaagctccccctgcctctttcccctaattagctcttaagcaaagagancctggcctccaatttgccctttgggtacaaagaaggaatagaanatccgtggccttggggaagganaaaaaatntccataaanttttcaggcaactnaaacccnttccaggtaantcccagaaaaccaat

SEQ ID NO: 5 - DNA, 683 bp, Homo sapiens
  misc_feature (608)..(608): n is any nucleotide of a, t, g or c
gagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctgtcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgnctcggtaatacctgtctgatgccacagattttatttattctcccctaacccagggcaatgtcagctattgccagt

SEQ ID NO: 6 - DNA, 490 bp, Homo sapiens
  misc_feature (12)..(12): n is any nucleotide of a, t, g or c
  misc_feature (17)..(17): n is any nucleotide of a, t, g or c
  misc_feature (23)..(24): n is any nucleotide of a, t, g or c
  misc_feature (65)..(67): n is any nucleotide of a, t, g or c
  misc_feature (432)..(432): n is any nucleotide of a, t, g or c
  misc_feature (454)..(454): n is any nucleotide of a, t, g or c
  misc_feature (461)..(461): n is any nucleotide of a, t, g or c
  misc_feature (490)..(490): n is any nucleotide of a, t, g or c
gattcggcacgngggcnagggannggggcagacgtccgtagcgccccctcccgaggaggtcgagnnnggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgctttgagatagagataaatggacagctggtgttctccaagctggagaatgggggctttccctatgagaaagatctcattgaggccatccgaagaagccagtaatggagaaaccctagaaaagatcaccaacaagcccgtcctccctgcgtcatcctgtgactgcacaggactctgggttcctgctctgttctggggtccaaaccttggtctccctttggtcctgctgggagntccccctgcctctttcccctanttagctncttagcaaagagaccctggcctccacttn

SEQ ID NO: 7 - DNA, 557 bp, Homo sapiens
  misc_feature (28)..(28): n is any nucleotide of a, t, g or c
  misc_feature (504)..(504): n is any nucleotide of a, t, g or c
  misc_feature (527)..(527): n is any nucleotide of a, t, g or c
  misc_feature (545)..(545): n is any nucleotide of a, t, g or c
cgtccgtagcgccccctcccgaggaggnctgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgctttgagatagagataaatggacagctggtgttctccaagctggagaatgggggctttccctatgagaaagatctcattgaggccatccgaagagccagtaatggaagaaaccctagaaaagatcaccaacagccgtcctcccttgcgtcatcctgtgacttgcacaggactctgggttcctgctctgttcttggggtccaaacctttggtctccctttggtcctgctgggaagctccccctgcctcttttcccctacttaagctcctttagcaaagaagaacctgggccttccacttttgcccttttggggtacaaaagaaggaattagaaganttccgtgggcctttgggggcaangaagaagagaaactcttnccattgaacaat

SEQ ID NO: 8 - DNA, 508 bp, Homo sapiens
  misc_feature (12)..(13): n is any nucleotide of a, t, g or c
  misc_feature (19)..(20): n is any nucleotide of a, t, g or c
  misc_feature (23)..(23): n is any nucleotide of a, t, g or c
  misc_feature (27)..(27): n is any nucleotide of a, t, g or c
  misc_feature (31)..(31): n is any nucleotide of a, t, g or c
  misc_feature (33)..(33): n is any nucleotide of a, t, g or c
  misc_feature (44)..(44): n is any nucleotide of a, t, g or c
  misc_feature (442)..(442): n is any nucleotide of a, t, g or c
ggcccgagcggnngccagnngantgangagnangccggggcagncgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagntccccctggctcttttcccctacttaagctccttaagcaaagaagaccctggcctccaattttgtt

SEQ ID NO: 9 - DNA, 418 bp, Homo sapiens
cgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaccttggtctccctttggtcctgctgggagctcccctgcctctttccctact

SEQ ID NO: 10 - DNA, 411 bp, Homo sapiens
cgcatcgtggtggagtactgtgaaccctgcggcttcgaggcgacctacctggagctggccagtgctgtgaaggagcagtatccgggcatcgagatcgagtcgcgcctcgggggcacaggtgctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctggggagctccccctgcctctttcccctacttagctccttagcaaagagacctgggcctccattttgc

SEQ ID NO: 11 - DNA, 397 bp, Homo sapiens
tcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttag

SEQ ID NO: 12 - DNA, 389 bp, Homo sapiens
ggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggcttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttg

SEQ ID NO: 13 - DNA, 469 bp, Homo sapiens
  misc_feature (407)..(407): n is any nucleotide of a, t, g or c
  misc_feature (416)..(416): n is any nucleotide of a, t, g or c
  misc_feature (427)..(427): n is any nucleotide of a, t, g or c
  misc_feature (446)..(446): n is any nucleotide of a, t, g or c
  misc_feature (461)..(461): n is any nucleotide of a, t, g or c
ccggagcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgttgacttgcacaggactttgggttcctgctctgttcttggggtccaaacctttggtcttcccttttgttcctgnttggggagntcccccttgcntttttcccttatttaggtnctttagcaaagagancttggctt

SEQ ID NO: 14 - DNA, 608 bp, Homo sapiens
  misc_feature (15)..(16): n is any nucleotide of a, t, g or c
  misc_feature (26)..(26): n is any nucleotide of a, t, g or c
  misc_feature (31)..(31): n is any nucleotide of a, t, g or c
  misc_feature (34)..(34): n is any nucleotide of a, t, g or c
  misc_feature (523)..(523): n is any nucleotide of a, t, g or c
  misc_feature (525)..(525): n is any nucleotide of a, t, g or c
  misc_feature (597)..(597): n is any nucleotide of a, t, g or c
  misc_feature (599)..(599): n is any nucleotide of a, t, g or c
  misc_feature (605)..(605): n is any nucleotide of a, t, g or c
caggggccgagcggnngccagcgacngacgngangccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccaagtaatggagaaaccctagaaaagatcaccaacaagcccgtcctccctgcgtcatcctgtgactgcacagggactctgggttcctgctctcccggatctgtctccttcctctagccagcagtatggacagctggaccccctgaaactttcctctcctcttaactgggcagagtgttgtctctccccaaatttattaaaactaaaaatggantncattcctctgaaagcaaaacaaattcataattgggtgatattaatagagagggttttcggaagcagatttgntnatatgnaat

SEQ ID NO: 15 - DNA, 411 bp, Homo sapiens
  misc_feature (3)..(3): n is any nucleotide of a, t, g or c
  misc_feature (9)..(9): n is any nucleotide of a, t, g or c
  misc_feature (13)..(13): n is any nucleotide of a, t, g or c
  misc_feature (18)..(21): n is any nucleotide of a, t, g or c
  misc_feature (23)..(23): n is any nucleotide of a, t, g or c
  misc_feature (63)..(63): n is any nucleotide of a, t, g or c
  misc_feature (365)..(365): n is any nucleotide of a, t, g or c
  misc_feature (382)..(382): n is any nucleotide of a, t, g or c
  misc_feature (408)..(408): n is any nucleotide of a, t, g or c
ggncgccgncgantgagnnnnangccggggcagacgtccgtagcgccccctcccgaggagttngagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcttttgagatagagataaatggacagctggtgttctccaagctggagaatgggggctttccctatgagaaagatctcattgaggccatccgaagagccagtaatggagaaaccctagaaaagatcaccaacagccgttcctccctgcgtcatcctgtgactgncacaggactctgggttncctgctctgtttctggggtccaaacnttg

SEQ ID NO: 16 - DNA, 420 bp, Homo sapiens
  misc_feature (6)..(6): n is any nucleotide of a, t, g or c
  misc_feature (17)..(17): n is any nucleotide of a, t, g or c
  misc_feature (33)..(33): n is any nucleotide of a, t, g or c
  misc_feature (386)..(386): n is any nucleotide of a, t, g or c
  misc_feature (412)..(412): n is any nucleotide of a, t, g or c
gcgcgnattgagcgtangccggggcagacgtcngtagcgccccctcccgaggagttcgagccacgcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgctttgagatagagataaatggacagctggtgttctccaagctggagaatgggggctttccctatgagaaagatctcattgaggccatccgaagagccagtaatggagaaaccctagaaaagatcaccaacagccgtcctccctggcgttcatcctgtggactggcacaggacttctgggtttcctgctcnggtttctggggttccaaaccttggtntccctttt

SEQ ID NO: 17 - DNA, 447 bp, Homo sapiens
  misc_feature (8)..(8): n is any nucleotide of a, t, g or c
  misc_feature (11)..(11): n is any nucleotide of a, t, g or c
  misc_feature (20)..(20): n is any nucleotide of a, t, g or c
  misc_feature (22)..(22): n is any nucleotide of a, t, g or c
  misc_feature (48)..(48): n is any nucleotide of a, t, g or c
  misc_feature (253)..(253): n is any nucleotide of a, t, g or c
  misc_feature (357)..(357): n is any nucleotide of a, t, g or c
  misc_feature (409)..(409): n is any nucleotide of a, t, g or c
  misc_feature (415)..(415): n is any nucleotide of a, t, g or c
  misc_feature (420)..(420): n is any nucleotide of a, t, g or c
  misc_feature (431)..(431): n is any nucleotide of a, t, g or c
  misc_feature (441)..(441): n is any nucleotide of a, t, g or c
gcggcggnccncgatgaggngnagccggggcagacgtccgtagcgccncctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatnggggctttccctatgagaaagatctcattgaggccatccgaagagccagtaatggagaaaccctagaaaagatcaccaacagccgtcctccctgcgtcatcctntgactgcacaggacttttgggtttcctgctctgtttctgggggttccaaacnttggtnttccntttgtccctgnttgggagctncccctt

SEQ ID NO: 18 - DNA, 326 bp, Homo sapiens
  misc_feature (16)..(16): n is any nucleotide of a, t, g or c
gcgaccggatgggagnagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgctttgagatagagataaatggacagctggtgttctccaagctggagaatgggggctttccctatgagaaagatctcattgaggccatccgaagagccagtaatggagaaaccctagaaaagatcaccaac

SEQ ID NO: 19 - DNA, 584 bp, Homo sapiens
  misc_feature (7)..(7): n is any nucleotide of a, t, g or c
tagcgcnggcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttccc

SEQ ID NO: 20 - DNA, 488 bp, Homo sapiens
cacgaggcgagcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatctactcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagac

SEQ ID NO: 21 - DNA, 420 bp, Homo sapiens
cacgagggcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctact

SEQ ID NO: 22 - DNA, 429 bp, Homo sapiens
  misc_feature (43)..(43): n is any nucleotide of a, t, g or c
tgggtaattggattctcacccctccgccctacgcactgcactncgactcttagagatccccggacgagccgcagtcagacgtccgtagcgccccctcccgaggaggtttagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgc

SEQ ID NO: 23 - DNA, 343 bp, Homo sapiens
  misc_feature (13)..(13): n is any nucleotide of a, t, g or c
  misc_feature (18)..(18): n is any nucleotide of a, t, g or c
  misc_feature (23)..(23): n is any nucleotide of a, t, g or c
  misc_feature (28)..(29): n is any nucleotide of a, t, g or c
  misc_feature (33)..(33): n is any nucleotide of a, t, g or c
  misc_feature (304)..(304): n is any nucleotide of a, t, g or c
  misc_feature (327)..(327): n is any nucleotide of a, t, g or c
gggcccgagcggncgccngcgantgagnngtangccggggcagacgtccgtagcgccccctcccgaggagtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgctttgagatagagataaatggacagctggtgttctccaagctggagaatgggggctttccctatgagaaagatctcattgaggccatccgaanagccagtaatggagaaaccctanaaaagatcaccaacag

SEQ ID NO: 24 - DNA, 436 bp, Homo sapiens
  misc_feature (16)..(16): n is any nucleotide of a, t, g or c
  misc_feature (19)..(19): n is any nucleotide of a, t, g or c
  misc_feature (28)..(28): n is any nucleotide of a, t, g or c
  misc_feature (30)..(30): n is any nucleotide of a, t, g or c
  misc_feature (45)..(47): n is any nucleotide of a, t, g or c
  misc_feature (68)..(68): n is any nucleotide of a, t, g or c
  misc_feature (77)..(77): n is any nucleotide of a, t, g or c
  misc_feature (389)..(389): n is any nucleotide of a, t, g or c
  misc_feature (436)..(436): n is any nucleotide of a, t, g or c
atttcggcacagggcncgnattgagcgnangccggggcagacgtnnntagcgccccctcccgaggagntcgagccgnccagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcttttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtggactgcacaggaactctgggttncctgtcttctgtttctgggggtccaaaccttggttttccctttggtn

SEQ ID NO: 25 - DNA, 323 bp, Homo sapiens
  misc_feature (121)..(121): n is any nucleotide of a, t, g or c
  misc_feature (229)..(229): n is any nucleotide of a, t, g or c
  misc_feature (319)..(319): n is any nucleotide of a, t, g or c
ccgaggcagacgtccgtagcgccccctcccgaggaggtcgagccgggcagtggggtccgcatcgtggtggagtactgtgaaccctgcggcttcgaggcgacctacctggagctggccagtnctgtgaaggagcagtatccgggcatcgagatcgagtcgcgcctcgggggcacaggtgcctttgagatagagataaatggacagctggtgttctccaagctggagaatnggggctttccctatgagaaagatctcattgaggccatccgaagagccagtaatggagaaaccctagaaaagatcaccaacagccgtcctncctg

SEQ ID NO: 26 - DNA, 389 bp, Homo sapiens
  misc_feature (4)..(4): n is any nucleotide of a, t, g or c
  misc_feature (55)..(55): n is any nucleotide of a, t, g or c
  misc_feature (365)..(365): n is any nucleotide of a, t, g or c
gccnggagcagacgtccgtagcgccccctcccgaggaggtcgagccgggcagtcngggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgttcatcctgttgactgcacaggacttctgggttcctngttctgttcttggggttccaaact

SEQ ID NO: 27 - DNA, 460 bp, Homo sapiens
  misc_feature (3)..(3): n is any nucleotide of a, t, g or c
  misc_feature (337)..(337): n is any nucleotide of a, t, g or c
  misc_feature (393)..(393): n is any nucleotide of a, t, g or c
  misc_feature (418)..(418): n is any nucleotide of a, t, g or c
  misc_feature (428)..(428): n is any nucleotide of a, t, g or c
  misc_feature (440)..(440): n is any nucleotide of a, t, g or c
  misc_feature (446)..(446): n is any nucleotide of a, t, g or c
agntcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcttttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctggggtcctgcttctggttctnggggtccaaaacttgggtcttccttttgggcctgcttgggactttcccctggctcnttttccccaatttagctcccttagncaaaaagaancttgggcttcanatttgnccttttgggaaaag

SEQ ID NO: 28 - DNA, 436 bp, Homo sapiens
  misc_feature (278)..(278): n is any nucleotide of a, t, g or c
  misc_feature (376)..(376): n is any nucleotide of a, t, g or c
  misc_feature (405)..(405): n is any nucleotide of a, t, g or c
  misc_feature (417)..(417): n is any nucleotide of a, t, g or c
  misc_feature (434)..(434): n is any nucleotide of a, t, g or c
aagaaagtgaaccctgcggcttcgaggcgacctacctggagctggccagtgctgtgaaggagcagtatccgggcatcgagatcgagtcgcgcctcgggggcacaggtgctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactnactctgggttcctgctctgttctggggtccaaaccttgggtctcactttggtcctgctgggaagctccccctgcctcttttcccctacttaagctccntaagcaaaagagaaccttgggcctccaantttggccctttnggtacaaaaagaaaggnat

SEQ ID NO: 29 - DNA, 391 bp, Homo sapiens
  misc_feature (7)..(7): n is any nucleotide of a, t, g or c
  misc_feature (22)..(22): n is any nucleotide of a, t, g or c
  misc_feature (24)..(24): n is any nucleotide of a, t, g or c
  misc_feature (209)..(209): n is any nucleotide of a, t, g or c
  misc_feature (254)..(254): n is any nucleotide of a, t, g or c
  misc_feature (309)..(309): n is any nucleotide of a, t, g or c
  misc_feature (354)..(354): n is any nucleotide of a, t, g or c
  misc_feature (364)..(364): n is any nucleotide of a, t, g or c
  misc_feature (369)..(369): n is any nucleotide of a, t, g or c
cggcacncgcggattgaggtgnangccggggcagacgtccgtagcgccccctcccgaggagttcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcttttnagatagagataaatggacagctggtgttctccaagctggagaatnggggctttccctatgagaaagatcttcattgaggccatccgaagagccagtaatngagaaaccctagaaaagatcaccaacagccgtccttccttgcgtncatcctgttnacttncacaaggattcttgggtttcct

SEQ ID NO: 30 - DNA, 386 bp, Homo sapiens
  misc_feature (13)..(13): n is any nucleotide of a, t, g or c
  misc_feature (53)..(53): n is any nucleotide of a, t, g or c
  misc_feature (378)..(378): n is any nucleotide of a, t, g or c
gcggggagcgggngcagacgtccgtagcgccccctcccgaggaggtcgagccnggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgctttgagatagagataaatggacagctggtgttctccaagctggagaatgggggctttccctatgagaaagatcttcattgaggccatccgaagagccagtaatgggagaaacccttagaaaagattcaccaacagccgttcctccctggcgttcattccttgttgaattgcacagggattttggggtttcntgttttgt

SEQ ID NO: 31 - DNA, 348 bp, Homo sapiens
  misc_feature (226)..(226): n is any nucleotide of a, t, g or c
  misc_feature (315)..(315): n is any nucleotide of a, t, g or c
  misc_feature (336)..(336): n is any nucleotide of a, t, g or c
gcgcatcgtggtggagtactgtgaaccctgcggcttcgaggcgacctacctggagctggccagtgctgtgaaggagcagtatccgggcatcgagatcgagtcgcgcctcgggggcacaggtgctttgagatagagataaatggacagctggtgttctccaagctggagaatgggggctttccctatgagaaagatctcattgaggccatccgaagagccagtaatngagaaaccctagaaaagatcaccaacagccgtcctcccttgcgtcatcctgtgactgcacagggattctgggttccttgttctgttctnggggttcaaacctttgggttnccttttggtcct

SEQ ID NO: 32 - DNA, 344 bp, Homo sapiens
  misc_feature (27)..(28): n is any nucleotide of a, t, g or c
  misc_feature (56)..(57): n is any nucleotide of a, t, g or c
  misc_feature (110)..(110): n is any nucleotide of a, t, g or c
  misc_feature (157)..(157): n is any nucleotide of a, t, g or c
  misc_feature (215)..(215): n is any nucleotide of a, t, g or c
  misc_feature (305)..(305): n is any nucleotide of a, t, g or c
cccgagcggagcggccgcgatgagcgnngagccggggcagacgtccgtagcgcccnntcccgaggaggtcgagccgggcagtggggtccgcatcgtggtggagtactgtnaaccctgcggcttcgaggcgacctacctggagctggccagtgctgtnaaggagcagtatccgggcatcgagatcgagtcgcgcctcgggggcacaggtgcctttnagatagagataaatggacagctggtgttctccaagctggagaatggggggctttccctatgagaaagatctcattgaggccatccgaagngccagtaaatggagaaaccctagaaaagatcaccaacag

SEQ ID NO: 33 - DNA, 532 bp, Homo sapiens
tttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggtttctccattactggctcttcggatggcctcaatgagatctttctcatagggaaagcccccattctccagcttggagaacaccagctgtccatttatctctatctcaaaggcacctgt

SEQ ID NO: 34 - DNA, 309 bp, Homo sapiens
  misc_feature (10)..(10): n is any nucleotide of a, t, g or c
  misc_feature (225)..(225): n is any nucleotide of a, t, g or c
  misc_feature (230)..(230): n is any nucleotide of a, t, g or c
  misc_feature (289)..(289): n is any nucleotide of a, t, g or c
  misc_feature (293)..(293): n is any nucleotide of a, t, g or c
gcggagcgcnccgcgatgagcggcgagccggggcagacgtccgtagcgccccctcccgaggaggtcgagccgggcagtggggtccgcatcgtggtggagtactgtgaaccctgcggcttcgaggcgacctacctggagctggccatgctgtgaaggagcagtatccgggcatcgagatcgagtcgcgcctcgggggcacaggtgcctttgagatagagataaatngacanctggtgttcttcaagctggagaatgggggctttccctatgagaaagatctcattgaggncatncgaagagccataatgg

SEQ ID NO: 35 - DNA, 571 bp, Homo sapiens
  misc_feature (393)..(393): n is any nucleotide of a, t, g or c
  misc_feature (482)..(482): n is any nucleotide of a, t, g or c
  misc_feature (503)..(503): n is any nucleotide of a, t, g or c
  misc_feature (520)..(520): n is any nucleotide of a, t, g or c
agtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggttggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctnttggtgatcttttctagggtttctccattactggctcttcggatggcctcaatgagatctttctcaggggaaagccccattctccagcntggagaacaccagctgtccanttatctctatctcaaangcacctgtgccccgaagcgcgactcgattttcgatgcccggatactgctcc

SEQ ID NO: 36 - DNA, 263 bp, Homo sapiens
  misc_feature (17)..(17): n is any nucleotide of a, t, g or c
ggggcagacgtccgtancgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgctttgagatagagataaatggacagctggtgttctccaagctggagaatgggggctttcccctgagaaagatctcatttaggcccat

SEQ ID NO: 37 - DNA, 528 bp, Homo sapiens
  misc_feature (1)..(1): n is any nucleotide of a, t, g or c
  misc_feature (299)..(299): n is any nucleotide of a, t, g or c
  misc_feature (387)..(387): n is any nucleotide of a, t, g or c
  misc_feature (520)..(520): n is any nucleotide of a, t, g or c
ntttttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcaggggganctcccagcaggaccaaagggagaccaaggtttggaccccagaacagagcaggaacccagagtccttgtgcagtcacaggatgacgcanggaggacggctgttggtgatcttttctagggtttctccattactggctcttcggatggcctcaatgagatctttctcatagggaaagcccccattctccagcttggagaacaccagctgtccaattatctccntctcaaaa

SEQ ID NO: 38 - DNA, 290 bp, Homo sapiens
  misc_feature (11)..(11): n is any nucleotide of a, t, g or c
  misc_feature (29)..(29): n is any nucleotide of a, t, g or c
  misc_feature (158)..(158): n is any nucleotide of a, t, g or c
  misc_feature (188)..(188): n is any nucleotide of a, t, g or c
  misc_feature (254)..(254): n is any nucleotide of a, t, g or c
  misc_feature (270)..(270): n is any nucleotide of a, t, g or c
cccgagcggancggccgcgatgagcgagngagccggggcagacgtccgtagcgccccctcccgaggaggtcgagccgggcagtggggtccgcatcgtggtggagtactgtaaaccctgcggcttcgaggcgacctacctggagctggccagtgctgtnaaggagcagtatccgggcatcgagatcgantcgcgcctcgggggcacaggtgcctttaagatagagataaatggacagctggtgttctccaagctngagaatgggggctttncctatgagaaagatctcatt

SEQ ID NO: 39 - DNA, 320 bp, Homo sapiens
  misc_feature (101)..(101): n is any nucleotide of a, t, g or c
  misc_feature (113)..(113): n is any nucleotide of a, t, g or c
  misc_feature (172)..(172): n is any nucleotide of a, t, g or c
  misc_feature (256)..(256): n is any nucleotide of a, t, g or c
  misc_feature (285)..(285): n is any nucleotide of a, t, g or c
  misc_feature (292)..(292): n is any nucleotide of a, t, g or c
  misc_feature (297)..(297): n is any nucleotide of a, t, g or c
  misc_feature (308)..(308): n is any nucleotide of a, t, g or c
ggtggagtactgtgaaccctgcggcttcgaggcgacctacctggagctggccagtgctgtgaaggagcagtatccgggcatcgagatcgagtcgcgcctcnggggcacaggtnctttgagatagagataaatggacagctggtgttctccaagctggagaatgggggctttncctatgagaaagatctcattgaggccatccgaagagccagtaatggagaaacctagaaaagttcaccaacagccgtccttcctncgtcattctattgactgcacaggattctnggtttcntgctntgtttttgggntccaaacctttg

SEQ ID NO: 40 - DNA, 321 bp, Homo sapiens
  misc_feature (154)..(154): n is any nucleotide of a, t, g or c
  misc_feature (258)..(258): n is any nucleotide of a, t, g or c
  misc_feature (267)..(267): n is any nucleotide of a, t, g or c
  misc_feature (275)..(275): n is any nucleotide of a, t, g or c
  misc_feature (282)..(282): n is any nucleotide of a, t, g or c
  misc_feature (310)..(310): n is any nucleotide of a, t, g or c
ggagcagtatccgggcatcgagatcgagtcgcgcctcgggggcacaggtgctttgagatagagataaatggacagctggtgttctccaagctggagaatgggggctttccctatgagaaagatctcattgaggccatccgaagagccagtaatnggagaaaccctagaaaagatcaccaacagccgtcctacctgcgtcatcctgtgactgcacaggactctgggttcctgctctgttctgggggtccaaaccttggncttcctttnggtccctnttgggangttccccttgctttttttccctaattangttcctaggaa

SEQ ID NO: 41 - DNA, 456 bp, Homo sapiens
gcggggagcggggcagacgtccgtagcgccccctcccgaggaggtcgagctgctgcagtggggtccgcatcgtggtggagtactgtgaaccctgcggcttcgaggcgacctacctggagctggccagtgctgtgaaggagcagtatccgggcatcgagatcgagtcgcgcctcgggggacaggtgctttgagatagagataaatggacagctggtgttctccaagctggagaatgggggcttccctatgagaaagatgtgagtatttacagcgttgggaggacctcttggtcaccctaccccaacagtgcatcatcctgtcattccactcctctagctcattgaggccatccgaagagccagtaatggagaaaccctagaaaagatcaccaacagccgtcctccctgcgtcatcctgtgactgcacagactctgggttctgctctgttctggggtc

SEQ ID NO: 42 - DNA, 458 bp, Homo sapiens
  misc_feature (63)..(63): n is any nucleotide of a, t, g or c
  misc_feature (69)..(69): n is any nucleotide of a, t, g or c
  misc_feature (316)..(316): n is any nucleotide of a, t, g or c
  misc_feature (348)..(348): n is any nucleotide of a, t, g or c
  misc_feature (368)..(368): n is any nucleotide of a, t, g or c
  misc_feature (425)..(425): n is any nucleotide of a, t, g or c
  misc_feature (452)..(452): n is any nucleotide of a, t, g or c
ccaatagctgacattgccctgggttaggggagaataaataaaatctgtggcatcagacaggtnttaccnaggcgaagagtggactgggctttcgtgggcacttaccctgggaagggggtatgaggtggctggagaagttttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagngcaggaacccagagtcctgtgcagtcacaggntgacgcagggaggacggctntttggtgatcttttctagggtttctccttactggctcttcggatggcctcaatgagnttttctcatagggaaagcccccttttncagttt

SEQ ID NO: 43 - DNA, 452 bp, Homo sapiens
ttgtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagaacaggaccccagagtcctgtgcagtcacaggatgacgcagggaggacggctgttggtgatcttttctagggtttctccattactggctcttcggatggcctcaatgagcta

SEQ ID NO: 44 - DNA, 444 bp, Homo sapiens
agtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggtttctccattactggctcttcggatggcctcaa

SEQ ID NO: 45 - DNA, 232 bp, Homo sapiens
  misc_feature (13)..(13): n is any nucleotide of a, t, g or c
  misc_feature (23)..(23): n is any nucleotide of a, t, g or c
  misc_feature (147)..(147): n is any nucleotide of a, t, g or c
  misc_feature (182)..(182): n is any nucleotide of a, t, g or c
ggagccggccgcnatgagcgggngagccggggcagacgtccgtagcgccccctcccgaggaggtcgagccgggcagtggggtccgcatcgtggtggagtactgtaaaccctgcggcttcgaggcgacctacctggagctggccagtnctgtgaaggagcagtatccgggcatcgagatcgantcgcgcctcgggggcacaggtgcctttaagatagagataaatggacagct

SEQ ID NO: 46 - DNA, 456 bp, Homo sapiens
tttttttttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggtttctccattactggctcttcggatggctcaatgag

SEQ ID NO: 47 - DNA, 556 bp, Homo sapiens
  misc_feature (430)..(430): n is any nucleotide of a, t, g or c
  misc_feature (488)..(488): n is any nucleotide of a, t, g or c
  misc_feature (527)..(527): n is any nucleotide of a, t, g or c
  misc_feature (535)..(535): n is any nucleotide of a, t, g or c
  misc_feature (543)..(543): n is any nucleotide of a, t, g or c
gtatgcattttatgcctcaataaaaagtttagggaaaaaaacctcttattcttgtacagaatccatggttgttctctatatggaacagttagtaaagttctgggagtcctaagatctaaaaaaagaaatctaaccatccaacaccacctaaagccatcactcagatggaggggccatcacgaaaggatacttttggaggtggtctgcaaagaaaaaacttctagaaaaagacaacaaaatcggccaggtgtggtggctcacgcctgtaatcccagcgctttgggaggccgaggcgggcagatcacgaggtcaagagttcgagaccagcctgaccaacatagtggaaaccctggtctccacttaaaaattacaaaaaattaactggggcgtggttggccgcgcacctggtaatcccagctacttttggganggcttgggggcaggaagaatcgctttgaacctgggaaggttggaggttgcagttgaanccgaggttcgcaccactgcatttccagccttgggggaanagggcganactccgtntccaaaaaataat

SEQ ID NO: 48 - DNA, 461 bp, Homo sapiens
  misc_feature (6)..(6): n is any nucleotide of a, t, g or c
  misc_feature (371)..(371): n is any nucleotide of a, t, g or c
  misc_feature (393)..(393): n is any nucleotide of a, t, g or c
tttagngtttgtagcgccactttactgccaatagctgacattgccctgggttaggggagaataaataaaatctgtggcatcagacaggtattaccgaggcgaagagtggactgggctttcgtgggcacttaccctgggaaggggtatgaggtggctggagaagtgttcatggagagtgtctctctcctgcccccaaggccacggaatcttctattccttctttgtacccaaaggcaaagtggaggccagggtctctttgctaaggagctaagtaggggaaaaaggcagggggagctcccagcaggaccaaagggagaccaaggtttggaccccagaacagagcaggaacccagagtcctgtgcagtcacangatgacgcagggaggacggctnttggtgatcttttctagggtttctccattacttgctcttcggatggcctcaatgagatctttctcata

SEQ ID NO: 49 - DNA, 434 bp, Homo sapiens
gtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggtttctccattactggctcttcggatg

SEQ ID NO: 50 - DNA, 434 bp, Homo sapiens; identical to SEQ ID NO: 49

SEQ ID NO: 51 - DNA, 459 bp, Homo sapiens
tcagacctcattgaggccatccgaagagccaataatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctccctaacccagggcaatgtcagctattggcagtaaagtggcgctacaaacactaaaaaaa

SEQ ID NO: 52 - DNA, 451 bp, Homo sapiens
ttttttttttttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaaggggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggtttctccattactggctcttcggatgg

SEQ ID NO: 53 - DNA, 447 bp, Homo sapiens
  misc_feature (244)..(245): n is any nucleotide of a, t, g or c
  misc_feature (378)..(378): n is any nucleotide of a, t, g or c
tttttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaaggcaaagtnnaggccagggtctctttgctaaggagctaagtaggggaaagaggcagggggagctcccagcaggaccaaagggagaccaaggtttggaccccagaacagagcaggaacccagagtcctgtgcagtcacaggatnacgcagggaggacggctgttggtgatcttttctagggtttctccattactggctcttcggatggcctca

SEQ ID NO: 54 - DNA, 473 bp, Homo sapiens
tagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctcactcctgcccccaaggccacggaatcttctattccttctttgtacccaaaggcaaagtggaggccagggtctctttgctaaggagctaagtaggggaaagaggcagggggagctcccagcaggaccaaagggagaccaaggtttgggaccccagaacagagcaggaacccagagtcctgttgcagtcacaggatgacgcagggaggacggctgttggtgatcttttcttagggtttctccattacttgctctttcggatggcctcaatgagatcttttctcataggggaaat

SEQ ID NO: 55 - DNA, 454 bp, Homo sapiens
  misc_feature (373)..(373): n is any nucleotide of a, t, g or c
  misc_feature (445)..(445): n is any nucleotide of a, t, g or c
tagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggnttgaccgcagggaggaccggctgttggtgatccttttctagggtttctccattactggctcttccggatggnctcaatgag

SEQ ID NO: 56 - DNA, 394 bp, Homo sapiens
  misc_feature (390)..(390): n is any nucleotide of a, t, g or c
tgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggtttccccattnactg

SEQ ID NO: 57 - DNA, 427 bp, Homo sapiens
ttttttttttgtttgtagcgccactttactgccaatagctgacattgccctgggttaggggagaataaataaaatctgtggcatcagacaggtattaccgaggcgaagagtggactgggctttcgtgggcacttaccccgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttgtaccccagaacagagcaggaacccagagtcctgtgcagtcacaggatgacgcagggaggacggctgttggtgatcttttctagggtttctccat

SEQ ID NO: 58 - DNA, 421 bp, Homo sapiens
tttttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggtttct

SEQ ID NO: 59 - DNA, 419 bp, Homo sapiens
tttttttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggt

SEQ ID NO: 60 - DNA, 434 bp, Homo sapiens
tgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtagggggaaagaggcagggggagctcccagcaggaccaaagggagaccaaggtttggaccccagaacagagcaggaacccagagtcctgtgcagtcacaggattgacgcagggaggaccggctgttggtgatcttttctaagggtttctccattactgggctctt

SEQ ID NO: 61 - DNA, 418 bp, Homo sapiens
agcattagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaaggggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctaggg

SEQ ID NO: 62 - DNA, 403 bp, Homo sapiens
tagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatct

SEQ ID NO: 63 - DNA, 401 bp, Homo sapiens
gtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcaggaggacggctgttggtgatctttt

SEQ ID NO: 64 - DNA, 432 bp, Homo sapiens
  misc_feature (123)..(124): n is any nucleotide of a, t, g or c
  misc_feature (349)..(349): n is any nucleotide of a, t, g or c
  misc_feature (399)..(399): n is any nucleotide of a, t, g or c
actgccaatagctgacattgccctgggttaggggagaataaataaaatctgtggcatcagacaggtattaccgaggcgaagagtggactgggctttcgtgggcacttaccctgggaagggggnnatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccaggaacagagcaggaacccagagtcctgtggcagtncacaggatggacgcagggagggacggctgttcggtgaacttttctagggnttcccccattaaccggctcttcggatggcctct

SEQ ID NO: 65 - DNA, 501 bp, Homo sapiens
ttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattacttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcaatcacaggatgacgcagggaggacggctgttggtgatcttttctagggtttctccattactggctcttcggatggcctcaatgagatctttctcatagggaaagcccccattctccagcttggagaacaccagctg

SEQ ID NO: 66 - DNA, 792 bp, Homo sapiens
  misc_feature (2)..(2): n is any nucleotide of a, t, g or c
  misc_feature (21)..(21): n is any nucleotide of a, t, g or c
  misc_feature (73)..(73): n is any nucleotide of a, t, g or c
  misc_feature (106)..(106): n is any nucleotide of a, t, g or c
  misc_feature (116)..(117): n is any nucleotide of a, t, g or c
  misc_feature (232)..(232): n is any nucleotide of a, t, g or c
  misc_feature (246)..(246): n is any nucleotide of a, t, g or c
  misc_feature (263)..(263): n is any nucleotide of a, t, g or c
  misc_feature (295)..(295): n is any nucleotide of a, t, g or c
  misc_feature (304)..(304): n is any nucleotide of a, t, g or c
  misc_feature (311)..(311): n is any nucleotide of a, t, g or c
  misc_feature (321)..(321): n is any nucleotide of a, t, g or c
  misc_feature (325)..(325): n is any nucleotide of a, t, g or c
  misc_feature (328)..(328): n is any nucleotide of a, t, g or c1
  misc_feature (332)..(332): n is any nucleotide of a, t, g or c
  misc_feature (343)..(343): n is any nucleotide of a, t, g or c
  misc_feature (345)..(345): n is any nucleotide of a, t, g or c
  misc_feature (349)..(349): n is any nucleotide of a, t, g or c
  misc_feature (371)..(371): n is any nucleotide of a, t, g or c
  misc_feature (379)..(379): n is any nucleotide of a, t, g or c
  misc_feature (421)..(421): n is any nucleotide of a, t, g or c
  misc_feature (427)..(427): n is any nucleotide of a, t, g or c
  misc_feature (430)..(430): n is any nucleotide of a, t, g or c
  misc_feature (438)..(438): n is any nucleotide of a, t, g or c
  misc_feature (451)..(451): n is any nucleotide of a, t, g or c
  misc_feature (461)..(461): n is any nucleotide of a, t, g or c
  misc_feature (486)..(486): n is any nucleotide of a, t, g or c
  misc_feature (488)..(488): n is any nucleotide of a, t, g or c
  misc_feature (496)..(497): n is any nucleotide of a, t, g or c
  misc_feature (516)..(516): n is any nucleotide of a, t, g or c
  misc_feature (524)..(524): n is any nucleotide of a, t, g or c
  misc_feature (527)..(527): n is any nucleotide of a, t, g or c
  misc_feature (538)..(538): n is any nucleotide of a, t, g or c
  misc_feature (548)..(548): n is any nucleotide of a, t, g or c
  misc_feature (551)..(551): n is any nucleotide of a, t, g or c
  misc_feature (564)..(564): n is any nucleotide of a, t, g or c
  misc_feature (567)..(567): n is any nucleotide of a, t, g or c
  misc_feature (571)..(571): n is any nucleotide of a, t, g or c
  misc_feature (573)..(573): n is any nucleotide of a, t, g or c
  misc_feature (581)..(581): n is any nucleotide of a, t, g or c
  misc_feature (586)..(587): n is any nucleotide of a, t, g or c
  misc_feature (594)..(594): n is any nucleotide of a, t, g or c
  misc_feature (603)..(603): n is any nucleotide of a, t, g or c
  misc_feature (608)..(608): n is any nucleotide of a, t, g or c
  misc_feature (617)..(617): n is any nucleotide of a, t, g or c
  misc_feature (620)..(620): n is any nucleotide of a, t, g or c
  misc_feature (624)..(624): n is any nucleotide of a, t, g or c
  misc_feature (632)..(632): n is any nucleotide of a, t, g or c
  misc_feature (635)..(636): n is any nucleotide of a, t, g or c
  misc_feature (643)..(643): n is any nucleotide of a, t, g or c
  misc_feature (645)..(645): n is any nucleotide of a, t, g or c
  misc_feature (647)..(648): n is any nucleotide of a, t, g or c
  misc_feature (654)..(654): n is any nucleotide of a, t, g or c
  misc_feature (668)..(668): n is any nucleotide of a, t, g or c
  misc_feature (672)..(672): n is any nucleotide of a, t, g or c
  misc_feature (679)..(680): n is any nucleotide of a, t, g or c
  misc_feature (687)..(687): n is any nucleotide of a, t, g or c
  misc_feature (692)..(692): n is any nucleotide of a, t, g or c
  misc_feature (696)..(696): n is any nucleotide of a, t, g or c
  misc_feature (699)..(699): n is any nucleotide of a, t, g or c
  misc_feature (702)..(702): n is any nucleotide of a, t, g or c
  misc_feature (708)..(708): n is any nucleotide of a, t, g or c
  misc_feature (711)..(711): n is any nucleotide of a, t, g or c
  misc_feature (714)..(714): n is any nucleotide of a, t, g or c
  misc_feature (716)..(717): n is any nucleotide of a, t, g or c
  misc_feature (719)..(719): n is any nucleotide of a, t, g or c
  misc_feature (723)..(723): n is any nucleotide of a, t, g or c
  misc_feature (726)..(726): n is any nucleotide of a, t, g or c
  misc_feature (728)..(728): n is any nucleotide of a, t, g or c
  misc_feature (734)..(734): n is any nucleotide of a, t, g or c
  misc_feature (737)..(737): n is any nucleotide of a, t, g or c
  misc_feature (746)..(746): n is any nucleotide of a, t, g or c
  misc_feature (749)..(749): n is any nucleotide of a, t, g or c
  misc_feature (752)..(752): n is any nucleotide of a, t, g or c
  misc_feature (761)..(761): n is any nucleotide of a, t, g or c
  misc_feature (770)..(771): n is any nucleotide of a, t, g or c
  misc_feature (775)..(775): n is any nucleotide of a, t, g or c
  misc_feature (777)..(777): n is any nucleotide of a, t, g or c
  misc_feature (789)..(789): n is any nucleotide of a, t, g or c
  misc_feature (792)..(792): n is any nucleotide of a, t, g or c
cnggctgaggaattcggacgngggcagtactgtgaaggagcagtatccgggcatcgagatcgagtcgcgcctngggggcacaggtgctttgagatagagataaatngacagctggnnttctccaagctggagaatgggggctttccctatgagaaagatctcattgaggccatccgaagagccagtaatggagaaaccctagaaaagatcaccaacagccgtcctccctgcntcatcctgtgactncacaggactctgggttnctgctctgttctggggtccaaaccttggtctncctttggtnctgcttnggagctcccnctgnctntttnccctacttagntncttnagcaaagaggacccttggcctncactttancccttttggggtacaaaaggaagggaattaggaagatttccnttggcnttngaggggcnaaggaagatgagncaattttccnattaaacaactttttcaagcaaacntnaatacccnntttccccaggggtaaggtnccccacgnaanagcccaagtcnacattttttngcnttgggaaataccntantttnantccaaaanttttnntttaatntttccccanaaccnaagggaaanttnaagnaatttggnaannaaagttngngnntcaaancacaagataaaaanaaanaaaaaanntttgagnggggncccnganccnaatttngcncantnngngggnggntnaaaaancanatttgcagnggnttnaaaacagtntgagctttnnaaancntgggtttccaanaan

SEQ ID NO: 67 - DNA, 474 bp, Homo sapiens
tttttttttttgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggtttctccattactggctcttcggatggcctcaatgagatctttctcatagggaaa

SEQ ID NO: 68 - DNA, 483 bp, Homo sapiens
  misc_feature (248)..(248): n is any nucleotide of a, t, g or c
agtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccanggtctcttttgctaaggagcaaataagggaaagaggcagggggagctcccagcaagaccaaagggagaccaaggtttggaccccagaacagagcaggaacccagagtcctgtgcagtcacaggatgacgcagggaggacggctgttggtgatcttttctagggtttctccattactggctcttcggatggcctcaatgagatctttctcatagggaaagcccccattctccagct

SEQ ID NO: 69 - DNA, 449 bp, Homo sapiens
ttttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctatttcttttttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacggctgttggtgatcttttctagggtttctccattactggctcttcggatggcctcaat

SEQ ID NO: 70 - DNA, 594 bp, Homo sapiens
  misc_feature (385)..(385): n is any nucleotide of a, t, g or c
tagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggaaccaaggtttggaccccagaacagagcaggacccagagtcctgtgcagtcacaggatgacgcagggagcnggctgtgggtgatctttctaggggtttctccattactggctcttccgatgcctcactgagatctttctcatagggaaagcccccattctccagctttgagacgcaagctgtcatttatctctatctcaaggcaccctgtgcccccgaggcgaattcatctcgagccccgatactgctccttcacagactggcagttcaaggaagtcgcc

SEQ ID NO: 71 - DNA, 389 bp, Homo sapiens
tttttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggag

SEQ ID NO: 72 - DNA, 405 bp, Homo sapiens
  misc_feature (334)..(334): n is any nucleotide of a, t, g or c
  misc_feature (361)..(361): n is any nucleotide of a, t, g or c
  misc_feature (374)..(374): n is any nucleotide of a, t, g or c
agtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccanaacagagcaggaacccagagtcctgtncagtcacaggatnacgcagggaggacggctgttggtgatctttt

SEQ ID NO: 73 - DNA, 396 bp, Homo sapiens
  misc_feature (233)..(233): n is any nucleotide of a, t, g or c
ttttttttttgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacnccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggaggacg

SEQ ID NO: 74 - DNA, 392 bp, Homo sapiens
tttttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcatgaacccagagtcctgtgcagtcacaggatgacgcagggaggac

SEQ ID NO: 75 - DNA, 372 bp, Homo sapiens
  misc_feature (362)..(362): n is any nucleotide of a, t, g or c
ctgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaaggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacgcagggangaccggcttt

SEQ ID NO: 76 - DNA, 380 bp, Homo sapiens
ttttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgac

SEQ ID NO: 77 - DNA, 374 bp, Homo sapiens
gtttgtagcgccactttactgccaatagctgacattgccctgggttaggggagaataaataaaatctgtggcatcagacaggtattaccgaggcgaagagtggactgggctttcgtgggcacttaccctgggaaggtggtatgaggtggctggagaagtgttcatggagagtgtctctctcctgcccccaaggccacggaatcttctattccttctttgtacccaaaggtcaaagtggaggccagggtctctttgctaaggagctaagtaggggaaagaggcagggggagctcccagcaggaccaaagggagaccaaggtttggaccccagaacagagcaggaacccagagtcctgtgcagtcacaggatgacg

SEQ ID NO: 78 - DNA, 386 bp, Homo sapiens
ttttttttttttttttttttagtgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacagagcaggaacccagagtcctgtgcagtc

SEQ ID NO: 79 - DNA, 451 bp, Homo sapiens
  misc_feature (427)..(427): n is any nucleotide of a, t, g or c
tgtttgtagcgccactttactgccaatagctgacattgccctgggttaggggagaataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaaggcaaagtggaggccagggtctctttgctaaggagctaagtaggggaaagaggcagggggatctcccagcaggaccaaagggagaccaaggtttggaccccagaacagagcaaggaacccagagtcctgtgcagtcacaggattgacgcagggaggaccggcttgtttggtgatcctttcctagggtttctcccattanttggctctttccgattggcctcaa

SEQ ID NO: 80 - DNA, 311 bp, Homo sapiens
ataaataaaatctgtggcatcagacaggtattaccgaggcgaagagtggactgggctttcgtgggcacttaccctgggaagggggtatgaggtggctggagaagtgttcatggagagtgtctctctcctgcccccaaggccacggaatcttctattccttctttgtacccaaagggcaaagtggaggccagggtctctttgctaaggagctaagtaggggaaagaggcagggggagctcccagcaggaccaaagggagaccaaggtttggaccccagaacatagcaggaaccagagtcctgtgcagtcaca

SEQ ID NO: 81 - DNA, 412 bp, Homo sapiens
  misc_feature (126)..(126): n is any nucleotide of a, t, g or c
  misc_feature (349)..(349): n is any nucleotide of a, t, g or c
  misc_feature (390)..(390): n is any nucleotide of a, t, g or c
cactttactgccaatagctgacattgccctgggttaggggagaataaataaaatctgtggcatcagacaggtattaccgaggcgaagagtggactgggctttcgtgggcacttaccctgggaaggnggttatgaggtggctggagaagtgttcatggagagtgtctctctcctgcccccaaggcacggaatcttctattccttctttgtacccaaagggcaaagtggaggccagggtctctttgctaaggagctaagtaggggaaagaggcagggggagctcccagcaggaccaaagggagaccaaggtttgggaccccagaacagagcaggaacccagagtcctgttncagttcacaggatgacggcaggggagggacggcttttggtnatctttttttagggttttttcc

SEQ ID NO: 82 - DNA, 372 bp, Homo sapiens
  misc_feature (73)..(73): n is any nucleotide of a, t, g or c
  misc_feature (210)..(210): n is any nucleotide of a, t, g or c
  misc_feature (219)..(219): n is any nucleotide of a, t, g or c
  misc_feature (306)..(306): n is any nucleotide of a, t, g or c
  misc_feature (322)..(322): n is any nucleotide of a, t, g or c
  misc_feature (327)..(327): n is any nucleotide of a, t, g or c
  misc_feature (365)..(365): n is any nucleotide of a, t, g or c
actgccaatagctgacattgccctgggttaggggagaataaataaaatctgtggcatcagacaggtattaccnaggcgaagagtggactgggctttcgtgggcacttaccctgggaagggggtatgaggtggctggagaagtgttcatggagagtgtctctctcctgtccccaaggccacggaatcttctattccttctttgtacccaangggcaaagnggaggccagggtctctttgctaaggagctaagtaggggaaagaggcagggggagctcccagcaggaccaaagggggaccaaggtttnggaccccagaacagancaggnacccagagtcctttgcagtcacagggatgacgcagggnggacggc

SEQ ID NO: 83 - DNA, 401 bp, Homo sapiens
  misc_feature (328)..(328): n is any nucleotide of a, t, g or c
ttttttttttttttttttttttttttttagggtttgtagcgccactttactgccaatagctgacattgccctgggttaggggagaataaataaaatctggggcatcaaacaggttttaccgaggcgaaaagtggactgggctttcgtgggcacttaccctgggaagggggtatgagggggctggaaaagtgttcatggagagtgtctctctcctgcccccaaggccacggaatcttttattccttctttgtacccaaagggcaaagtggaggccagggtctttttgctaaggagctaaataggggaaagaggcagggggagctcccancaggaccaaagggagaccaaggtttggaccccaaaacaaagcaggaacccaaagtcctgtgcagtcacaggat

SEQ ID NO: 84 - DNA, 733 bp, Homo sapiens
gggatccggagcccaaatcttctgacaaaactcacacatgcccaccgtgcccagcacctgaattcgagggtgcaccgtcagtcttcctcttccccccaaaacccaaggacaccctcatgatctcccggactcctgaggtcacatgcgtggtggtggacgtaagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaacccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagtgcgacggccgcgactctagaggat

SEQ ID NO: 85 - protein, 9 aa, Homo sapiens
STEPGQTSV

SEQ ID NO: 86 - protein, 9 aa, Homo sapiens
STEPGQISY

SEQ ID NO: 87 - protein, 9 aa, Homo sapiens
GTEPSRLGY

SEQ ID NO: 88 - protein, 9 aa, Homo sapiens
FLIEINWYL

SEQ ID NO: 89 - protein, 10 aa, Homo sapiens
FLYEKDLIEA

SEQ ID NO: 90 - protein, 10 aa, Homo sapiens
FLYEKDLIEV

SEQ ID NO: 91 - protein, 9 aa, Homo sapiens
GVFPYEKDL

SEQ ID NO: 92 - protein, 10 aa, Homo sapiens
CVEFATYLEL

SEQ ID NO: 93 - protein, 10 aa, Homo sapiens
FVYEKDLIEA

SEQ ID NO: 94 - protein, 9 aa, Homo sapiens
QYPGIEIEL

SEQ ID NO: 95 - protein, 10 aa, Homo sapiens
IYGQLVFSKL

SEQ ID NO: 96 - protein, 9 aa, Homo sapiens
KLENGGFPK

SEQ ID NO: 97 - protein, 9 aa, Homo sapiens
ILGQLVFSK

SEQ ID NO: 98 - protein, 10 aa, Homo sapiens
LLNGGFPYEK

SEQ ID NO: 99 - protein, 9 aa, Homo sapiens
IVGQLVFSK

SEQ ID NO: 100 - protein, 10 aa, Homo sapiens
LVNGGFPYEK

SEQ ID NO: 101 - protein, 9 aa, Homo sapiens
KILIEAIRR

SEQ ID NO: 102 - protein, 9 aa, Homo sapiens
YVGIEIESR

SEQ ID NO: 103 - protein, 9 aa, Homo sapiens
EVVEPGSGR

SEQ ID NO: 104 - protein, 9 aa, Homo sapiens
SRLGGTGAL

SEQ ID NO: 105 - protein, 10 aa, Homo sapiens
ERITNSRPPL

SEQ ID NO: 106 - protein, 9 aa, Homo sapiens
EEVEPGSGL

SEQ ID NO: 107 - protein, 10 aa, Homo sapiens
IEIESRLGGL

SEQ ID NO: 108 - protein, 9 aa, Homo sapiens
VEPGSGVRL

SEQ ID NO: 109 - protein, 10 aa, Homo sapiens
FEIEINGQLL

SEQ ID NO: 110 - protein, 9 aa, Homo sapiens
FEATYLELV

SEQ ID NO: 111 - protein, 10 aa, Homo sapiens
KELIEAIRRV

SEQ ID NO: 112 - protein, 9 aa, Homo sapiens
EQCGFEATY

SEQ ID NO: 113 - protein, 10 aa, Homo sapiens
EQRLGGTGAF

SEQ ID NO: 114 - protein, 10 aa, Homo sapiens
GQGVRIVVEY

SEQ ID NO: 115 - protein, 9 aa, Homo sapiens
NPRPPCVIL

SEQ ID NO: 116 - protein, 10 aa, Homo sapiens
EPGSGVRIVL

SEQ ID NO: 117 - protein, 9 aa, Homo sapiens
ETLEKITNL

SEQ ID NO: 118 - protein, 8 aa, Homo sapiens
EAIRRASL

SEQ ID NO: 119 - protein, 10 aa, Homo sapiens
IARASNGETL

SEQ ID NO: 120 - protein, 9 aa, Homo sapiens
RRASNGETF

SEQ ID NO: 121 - protein, 10 aa, Homo sapiens
VRIVVEYCEY

SEQ ID NO: 122 - protein, 9 aa, Homo sapiens
IRRASNGEL

SEQ ID NO: 123 - protein, 10 aa, Homo sapiens
RRASNGETLL

SEQ ID NO: 124 - protein, 9 aa, Homo sapiens
FPKLENGGM

SEQ ID NO: 125 - protein, 10 aa, Homo sapiens
FPYEKDLIEM

SEQ ID NO: 126 - protein, 9 aa, Homo sapiens
FDIEINGQL

SEQ ID NO: 127 - protein, 10 aa, Homo sapiens
FDIEINGQLI

SEQ ID NO: 128 - protein, 9 aa, Homo sapiens
GHEATYLEL

SEQ ID NO: 129 - protein, 10 aa, Homo sapiens
AHEIEINGQL

SEQ ID NO: 130 - protein, 9 aa, Homo sapiens
RHASNGETL

SEQ ID NO: 131 - protein, 10 aa, Homo sapiens
CHFEATYLEL

SEQ ID NO: 132 - protein, 9 aa, Homo sapiens
NKQLVFSKL

SEQ ID NO: 133 - protein, 9 aa, Homo sapiens
IEINGQLVY

SEQ ID NO: 134 - protein, 10 aa, Homo sapiens
IEIESRLGGY

SEQ ID NO: 135 - protein, 9 aa, Homo sapiens
LPGTGAFEI

SEQ ID NO: 136 - protein, 10 aa, Homo sapiens
SPVKEQYPGI

SEQ ID NO: 137 - protein, 9 aa, Homo sapiens
GPFPYEKDI

SEQ ID NO: 138 - protein, 10 aa, Homo sapiens
SPVKEQYPGI

SEQ ID NO: 139 - protein, 9 aa, Homo sapiens
LAFTGAFEI

SEQ ID NO: 140 - protein, 10 aa, Homo sapiens
EAGSGVRIVV

SEQ ID NO: 141 - protein, 9 aa, Homo sapiens
LQINGQLVI

SEQ ID NO: 142 - protein, 10 aa, Homo sapiens
VQPGSGVRIV

SEQ ID NO: 143 - protein, 9 aa, Homo sapiens
FSKLENGGW

SEQ ID NO: 144 - protein, 10 aa, Homo sapiens
GSGVRIVVEW

SEQ ID NO: 145 - protein, 10 aa, Homo sapiens
SAVKEQYPGL

SEQ ID NO: 146 - protein, 9 aa, Homo sapiens
EFCGFEATL

SEQ ID NO: 147 - protein, 10 aa, Homo sapiens
VFSKLENGGL

SEQ ID NO: 148 - DNA, 384 bp, Artificial Sequence
  cDNA of 1E11/1F2 V-genes (Kappa)
atggattttcaggtgcagattttcagcttcctgctaatcagtgcctcagtcagaatgtccagaggacaaattgttctcacccagtctccagcaatcatgtctgcatctccaggggagaaggtcaccatatcctgcagtgccagctcaagtgtaagttacatgaactggtaccagcagaagccaggatcctcccccaaaccctggatttatcacacatccaacctggcttctggagtccctgctcgcttcagtggcagtgggtctgggacctcttactctctcacaatcagcagcatggaggctgaagatgctgccacttattactgccaacagtatcatagttacccacccacgttcggaggggggaccaagctggaaataaaa

SEQ ID NO: 149 - DNA, 402 bp, Artificial Sequence
  cDNA of 1E11/1F2 V-genes (IgG1)
atgaaagtgttgagtctgttgtacctgttgacagccattcctggtatcctgtctgatgtacagcttcaggagtcaggacctggcctcgtgaaaccttctcagtctctgtctctcacctgctctgtcactggctactccatcaccagtggttatttctggaactggatccggcagtttccagggaacaaactggaatggatgggctacataagctacgacggtagcaataactccaacccatctctcaaaaatcgaatctccttcactcgtgacacatctaagaaccagtttttcctgaagtttaattctgtgactactgacgactcagctgcatattactgtacaagaggaactacggggtttgcttactggggccaagggactctggtcactgtctctgca

SEQ ID NO: 150 - DNA, 381 bp, Artificial Sequence
  cDNA of 3E10 V-genes (Kappa)
atgaggttccaggttcaggttctggggctccttctgctctggatatcaggtgcccactgtgatgtccagataacccagtctccatcttttcttgctgcatctcctggagaaaccattactattaattgcagggcaagtaagtacattagcaaacatttagtctggtatcaggagaaacctggagaaactaaaaagcttcttatctactctggatccactttgcaatctggacttccatcaaggttcagtggcagtggatctggtacagatttcactctcaccatcagtagcctggagcctgaagattttgcaatgtattactgtcaacagcataatgaatacccgctcacgttcggtgctgggaccaagctggagctgaaa

SEQ ID NO: 151 - DNA, 420 bp, Artificial Sequence
  cDNA of 3E10 V-genes (IgG1)
atgatggtgttaagtcttctgtacctgttgacagcccttccgggtatcctgtcagaggtgcagcttcaggagtcaggacctagcctcgtgaaaccttctcagactctgtccctcacctgttctgtcactggcgactccatcaccagtggttactggaactggatccggaaattcccaggaaataaacttgaatacgtggggtacataagctacagtggtggcacttactacaatccatctctcaaaagtcgaatctccatcactcgagacacatccaagaaccactactacctgcagttgaattctgtgactactgaggacacagccacatattactgtgcaagaggtgcttactacgggggggccttttttccttacttcgatgtctggggcgctgggaccacggtcaccgtctcctca

SEQ ID NO: 152 - DNA, 310 bp, Homo sapiens
  misc_feature (173)..(173): n is any nucleotide of a, t, g, or c
  misc_feature (173)..(173): n is any nucleotide of a, t, g, or c
acacacccggaagcaggggcccgagsggascggccgcgatgagcggggagccggggcagacgtccgtagcgccccctcccgaggaggtcgakccgggcagtggggtccgcatcgtggtggagtactgtgaaccctgcggcttcgaggcgacctacctggagctggccagtgcnstgaaggagcagtatccgggcatcgagatcgagtcgcgcctcgggggcacaggtgcctttgagatagagataaatggacagctsggtgttctccargstggagaatggggstttccctatgagaaagatgtgagtct

SEQ ID NO: 153 - protein, 90 aa, Homo sapiens
  MISC_FEATURE (18)..(18): Xaa is an unknown amino acid
  MISC_FEATURE (46)..(46): Xaa is an unknown amino acid
  MISC_FEATURE (78)..(78): Xaa is an unknown amino acid
MSGEPGQTSVAPPPEEVXPGSGVRIVVEYCEPCGFEATYLELASAXKEQYPGIEIESRLGGTGAFEIEINGQLGVLQXGEWGFPYEKDVS

SEQ ID NO: 154 - DNA, 845 bp, Homo sapiens
  misc_feature (823)..(823): n is any nucleotide of a, t, g, or c
  misc_feature (825)..(825): n is any nucleotide of a, t, g, or c
ggcagaggttcacacccggaagcaggggcccgaggcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaaaaaaaaaaaaaaaaaaaaaaaaaaaaaaaaaaaaaaaaaaaaaaaaaaaaaaaaaaaatntngggggggggccccccccccc

SEQ ID NO: 155 - protein, 131 aa, Homo sapiens
AEVHTRKQGPEAEPAAMSGEPGQTSVAPPPEEVEPGSGVRIVVEYCEPCGFEATYLELASAVKEQYPGIEIESRLGGTGAFEIEINGQLVFSKLENGGFPYEKDLIEAIRRASNGETLEKITNSRPPCVIL

SEQ ID NO: 156 - DNA, 404 bp, Homo sapiens
  misc_feature (14)..(14): n is any nucleotide of a, t, g, or c
  misc_feature (17)..(17): n is any nucleotide of a, t, g, or c
  misc_feature (21)..(21): n is any nucleotide of a, t, g, or c
  misc_feature (23)..(23): n is any nucleotide of a, t, g, or c
actgtgaaccctgnggnttcnangcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggt

SEQ ID NO: 157 - protein, 10 aa, Homo sapiens
KITNSRPPSV

SEQ ID NO: 158 - protein, 9 aa, Homo sapiens
ITNSRPPSV

SEQ ID NO: 159 - protein, 9 aa, Homo sapiens
ILNSRPPSV

SEQ ID NO: 160 - protein, 9 aa, Homo sapiens
IMNSRPPSV

SEQ ID NO: 161 - protein, 9 aa, Artificial
  synthetic analog of human C35 epitope
GVRIVVEYA

SEQ ID NO: 162 - protein, 9 aa, Artificial
  synthetic analog of human C35 epitope
GVRIVVEYG

SEQ ID NO: 163 - protein, 9 aa, Artificial
  synthetic analog of human C35 epitope
IVVEYAEPC

SEQ ID NO: 164 - protein, 9 aa, Artificial
  synthetic analog of human C35 epitope
IVVEYCEPA

SEQ ID NO: 165 - protein, 9 aa, Artificial
  synthetic analog of human C35 epitope
IVVEYGEPC

SEQ ID NO: 166 - protein, 9 aa, Artificial
  synthetic analog of human C35 epitope
IVVEYCEPG

SEQ ID NO: 167 - protein, 9 aa, Artificial
  synthetic analog of human C35 epitope
IVVEYAEPA

SEQ ID NO: 168 - protein, 9 aa, Artificial
  synthetic analog of human C35 epitope
IVVEYAEPG

SEQ ID NO: 169 - protein, 9 aa, Artificial
  synthetic analog of human C35 epitope
IVVEYGEPA

SEQ ID NO: 170 - protein, 9 aa, Artificial
  synthetic analog of human C35 epitope
IVVEYGEPG

SEQ ID NO: 171 - protein, 9 aa, Artificial
  synthetic analog of human C35 epitope
KLENGGFPV

SEQ ID NO: 172 - protein, 9 aa, Artificial
  synthetic analog of human C35 epitope
KITNSRPPL

SEQ ID NO: 173 - protein, 9 aa, Artificial
  synthetic analog of human C35 epitope
KITNSRPPA

SEQ ID NO: 174 - protein, 9 aa, Artificial
  synthetic analog of human C35 epitope
KITNSRPPG

SEQ ID NO: 175 - protein, 10 aa, Artificial
  synthetic analog of human C35 epitope
KITNSRPPLV

SEQ ID NO: 176 - protein, 10 aa, Artificial
  synthetic analog of human C35 epitope
KITNSRPPAV

SEQ ID NO: 177 - protein, 10 aa, Artificial
  synthetic analog of human C35 epitope
KITNSRPPGV

SEQ ID NO: 178 - protein, 10 aa, Artificial
  synthetic analog of human C35 epitope
KITNSRPPSV

SEQ ID NO: 179 - protein, 9 aa, Artificial
  synthetic analog of human C35 epitope
ILNSRPPCV

SEQ ID NO: 180 - protein, 9 aa, Artificial
  synthetic analog of human C35 epitope
IMNSRPPCV

SEQ ID NO: 181 - protein, 9 aa, Artificial
  synthetic analog of human C35 epitope
ITNSRPPAV

SEQ ID NO: 182 - protein, 9 aa, Artificial
  synthetic analog of human C35 epitope
ITNSRPPGV

SEQ ID NO: 183 - protein, 9 aa, Artificial
  synthetic analog of human C35 epitope
ILNSRPPAV

SEQ ID NO: 184 - protein, 9 aa, Artificial
  synthetic analog of human C35 epitope
ILNSRPPGV

SEQ ID NO: 185 - protein, 9 aa, Artificial
  synthetic analog of human C35 epitope
IMNSRPPAV

SEQ ID NO: 186 - protein, 9 aa, Artificial
  synthetic analog of human C35 epitope
IMNSRPPGV

SEQ ID NO: 187 - protein, 9 aa, Artificial
  synthetic analog of human C35 epitope
ILNSRPPSV

SEQ ID NO: 188 - protein, 9 aa, Artificial
  synthetic analog of human C35 epitope
IMNSRPPSV

SEQ ID NO: 189 - protein, 9 aa, Artificial
  synthetic analog of human C35 epitope
ITNSRPPSV

SEQ ID NO: 190 - protein, 9 aa, Artificial
  synthetic analog of human C35 epitope
NSRPPAVIL

SEQ ID NO: 191 - protein, 9 aa, Artificial
  synthetic analog of human C35 epitope
NSRPPGVIL

SEQ ID NO: 192 - protein, 13 aa, Artificial
  synthetic analog of human C35 epitope
TLEKITNSRPPAV

SEQ ID NO: 193 - protein, 13 aa, Artificial
  synthetic analog of human C35 epitope
TLEKITNSRPPGV

SEQ ID NO: 194 - protein, 14 aa, Artificial [sequence omitted]

SEQ ID NO: 195 - protein, 14 aa, Artificial [sequence omitted]

SEQ ID NO: 196 - protein, 15 aa, Artificial
  synthetic analog of human C35 epitope
GETLEKITNSRPPAV

SEQ ID NO: 197 - protein, 15 aa, Artificial
  synthetic analog of human C35 epitope
GETLEKITNSRPPGV

SEQ ID NO: 198 - protein, 21 aa, Artificial
  synthetic analog of human C35 epitope
IRRASNGETLEKITNSRPPAV

SEQ ID NO: 199 - protein, 21 aa, Artificial
  synthetic analog of human C35 epitope
IRRASNGETLEKITNSRPPGV

SEQ ID NO: 200 - protein, 26 aa, Artificial
  synthetic analog of human C35 epitope
DLIEAIRRASNGETLEKITNSRPPAV

SEQ ID NO: 201 - protein, 26 aa, Artificial
  synthetic analog of human C35 epitope
DLIEAIRRASNGETLEKITNSRPPGV

SEQ ID NO: 202 - protein, 30 aa, Artificial
  synthetic analog of human C35 epitope
PYEKDLIEAIRRASNGETLEKITNSRPPAV

SEQ ID NO: 203 - protein, 30 aa, Artificial
  synthetic analog of human C35 epitope
PYEKDLIEAIRRASNGETLEKITNSRPPGV

SEQ ID NO: 204 - protein, 37 aa, Artificial
  synthetic analog of human C35 epitope
KLENGGFPYEKDLIEAIRRASNGETLEKITNSRPPAV

SEQ ID NO: 205 - protein, 37 aa, Artificial
  synthetic analog of human C35 epitope
KLENGGFPYEKDLIEAIRRASNGETLEKITNSRPPGV

SEQ ID NO: 206 - protein, 42 aa, Artificial
  synthetic analog of human C35 epitope
QLVFSKLENGGFPYEKDLIEAIRRASNGETLEKITNSRPPAV

SEQ ID NO: 207 - protein, 42 aa, Artificial
  synthetic analog of human C35 epitope
QLVFSKLENGGFPYEKDLIEAIRRASNGETLEKITNSRPPGV

SEQ ID NO: 208 - protein, 49 aa, Artificial
  synthetic analog of human C35 epitope
FEIEINGQLVFSKLENGGFPYEKDLIEAIRRASNGETLEKITNSRPPAV

SEQ ID NO: 209 - protein, 49 aa, Artificial
  synthetic analog of human C35 epitope
FEIEINGQLVFSKLENGGFPYEKDLIEAIRRASNGETLEKITNSRPPGV

SEQ ID NO: 210 - protein, 55 aa, Artificial
  synthetic analog of human C35 epitope
LGGTGAFEIEINGQLVFSKLENGGFPYEKDLIEAIRRASNGETLEKITNSRPPAV

SEQ ID NO: 211 - protein, 55 aa, Artificial
  synthetic analog of human C35 epitope
LGGTGAFEIEINGQLVFSKLENGGFPYEKDLIEAIRRASNGETLEKITNSRPPGV

SEQ ID NO: 212 - protein, 9 aa, Homo sapiens
EADPTGHSY

SEQ ID NO: 213 - protein, 9 aa, Artificial
  synthetic human C35/MAGE-1 polytope
SAYGEPRKL

SEQ ID NO: 214 - protein, 9 aa, Homo sapiens
EVDPIGHLY

SEQ ID NO: 215 - protein, 9 aa, Homo sapiens
FLWGPRALV

SEQ ID NO: 216 - protein, 10 aa, Homo sapiens
MEVDPIGHLY

SEQ ID NO: 217 - protein, 9 aa, Homo sapiens
AARAVFLAL

SEQ ID NO: 218 - protein, 8 aa, Homo sapiens
YRPRPRRY

SEQ ID NO: 219 - protein, 10 aa, Homo sapiens
SPSSNRIRNT

SEQ ID NO: 220 - protein, 10 aa, Homo sapiens
VLPDVFIRCV

SEQ ID NO: 221 - protein, 9 aa, Homo sapiens
EEKLIVVLF

SEQ ID NO: 222 - protein, 9 aa, Homo sapiens
EEKLSVVLF

SEQ ID NO: 223 - protein, 10 aa, Homo sapiens
ACDPHSGHFV

SEQ ID NO: 224 - protein, 10 aa, Homo sapiens
ARDPHSGHFV

SEQ ID NO: 225 - protein, 9 aa, Homo sapiens
SYLDSGIHF

SEQ ID NO: 226 - protein, 9 aa, Homo sapiens
SYLDSGIHS

SEQ ID NO: 227 - protein, 9 aa, Homo sapiens
MLLAVLYCL

SEQ ID NO: 228 - protein, 9 aa, Homo sapiens
YMNGTMSQV

SEQ ID NO: 229 - protein, 9 aa, Homo sapiens
YMDGTMSQV

SEQ ID NO: 230 - protein, 9 aa, Homo sapiens
AFLPWHRLF

SEQ ID NO: 231 - protein, 9 aa, Homo sapiens
SEIWRDIDF

SEQ ID NO: 232 - protein, 9 aa, Homo sapiens
YEIWRDIDF

SEQ ID NO: 233 - protein, 15 aa, Homo sapiens
QNILLSNAPLGPQFP

SEQ ID NO: 234 - protein, 15 aa, Artificial
  synthetic human C35/Tyrosinase polytope
DYSYLQDSDPDSFQD

SEQ ID NO: 235 - protein, 10 aa, Homo sapiens
EAAGIGILTV

SEQ ID NO: 236 - protein, 9 aa, Homo sapiens
ILTVILGVL

SEQ ID NO: 237 - protein, 9 aa, Homo sapiens
KTWGQYWQV

SEQ ID NO: 238 - protein, 9 aa, Homo sapiens
ITDQVPFSV

SEQ ID NO: 239 - protein, 9 aa, Homo sapiens
YLEPGPVTA

SEQ ID NO: 240 - protein, 10 aa, Homo sapiens
LLDGTATLRL

SEQ ID NO: 241 - protein, 10 aa, Homo sapiens
VLYRYGSFSV

SEQ ID NO: 242 - protein, 9 aa, Homo sapiens
LYVDSLFFL

SEQ ID NO: 243 - protein, 12 aa, Homo sapiens
KISGGPRISYPL

SEQ ID NO: 244 - protein, 11 aa, Homo sapiens
SLLMWITQCFL

SEQ ID NO: 245 - protein, 9 aa, Homo sapiens
SLLMWITQC

SEQ ID NO: 246 - protein, 9 aa, Homo sapiens
QLSLLMWIT

SEQ ID NO: 247 - protein, 18 aa, Artificial
  synthetic human C35/MAGE-1 polytope
SVAPPPEEVEADPTGHSY

SEQ ID NO: 248 - protein, 28 aa, Artificial
  synthetic human C35/MAGE-1 polytope
EADPTGHSYSVAAPPPEEVEADPTGHSY

SEQ ID NO: 249 - protein, 18 aa, Artificial
  synthetic human C35/MAGE-1 polytope
SVAPPPEEVSAYGEPRKL

SEQ ID NO: 250 - protein, 27 aa, Artificial
  synthetic human C35/MAGE-1 polytope
SAYGEPRKLSVAPPPEEVSAYGEPRKL

SEQ ID NO: 251 - protein, 18 aa, Artificial
  synthetic human C35/MAGE-3 polytope
SVAPPPEEVEVDPIGHLY

SEQ ID NO: 252 - protein, 27 aa, Artificial
  synthetic human C35/MAGE-3 polytope
EVDPIGHLYSVAPPPEEVEVDPIGHLY

SEQ ID NO: 253 - protein, 18 aa, Artificial
  synthetic human C35/MAGE-3 polytope
SVAPPPEEVFLWGPRALV

SEQ ID NO: 254 - protein, 27 aa, Artificial
  synthetic human C35/MAGE-3 polytope
FLWGPRALVSVAPPPEEVFLWGPRALV

SEQ ID NO: 255 - protein, 19 aa, Artificial
  synthetic human C35/MAGE-3 polytope
SVAPPPEEVMEVDPIGHLY

SEQ ID NO: 256 - protein, 29 aa, Artificial
  synthetic human C35/MAGE-3 polytope
MEVDPIGHLYSVAPPPEEVMEVDPIGHLY

SEQ ID NO: 257 - protein, 18 aa, Artificial
  synthetic human C35/BAGE polytope
SVAPPPEEVAARAVFLAL

SEQ ID NO: 258 - protein, 27 aa, Artificial
  synthetic human C35/BAGE polytope
AARAVFLALSVAPPPEEVAARAVFLAL

SEQ ID NO: 259 - protein, 17 aa, Artificial
  synthetic human C35/GAGE-1,2 polytope
SVAPPPEEVYRPRPRRY

SEQ ID NO: 260 - protein, 25 aa, Artificial
  synthetic human C35/GAGE-1,2 polytope
YRPRPRRYSVAPPPEEVYRPRPRRY

SEQ ID NO: 261 - protein, 19 aa, Artificial
  synthetic human C35/RAGE polytope
SVAPPPEEVSPSSNRIRNT

SEQ ID NO: 262 - protein, 29 aa, Artificial
  synthetic human C35/RAGE polytope
SPSSNRIRNTSVAPPPEEVSPSSNRIRNT

SEQ ID NO: 263 - protein, 19 aa, Artificial
  synthetic human C35/CDK4 polytope
SVAPPPEEVARDPHSGHFV

SEQ ID NO: 264 - protein, 29 aa, Artificial
  synthetic human C35/CDK4 polytope
ARDPHSGHFVSVAPPPEEVARDPHSGHFV

SEQ ID NO: 265 - protein, 18 aa, Artificial
  synthetic human C35/beta-catenin polytope
SVAPPPEEVSYLDSGIHS

SEQ ID NO: 266 - protein, 27 aa, Artificial
  synthetic human C35/beta-catenin polytope
SYLDSGIHSSVAPPPEEVSYLDSGIHS

SEQ ID NO: 267 - protein, 18 aa, Artificial
  synthetic human C35/Tyrosinase polytope
SVAPPPEEVMLLAVLYCL

SEQ ID NO: 268 - protein, 27 aa, Artificial
  synthetic human C35/Tyrosinase polytope
MLLAVLYCLSVAPPPEEVMLLAVLYCL

SEQ ID NO: 269 - protein, 18 aa, Artificial
  synthetic human C35/Tyrosinase polytope
SVAPPPEEVAFLPWHRLF

SEQ ID NO: 270 - protein, 27 aa, Artificial
  synthetic human C35/Tyrosinase polytope
AFLPWHRLFSVAPPPEEVAFLPWHRLF

SEQ ID NO: 271 - protein, 24 aa, Artificial
  synthetic human C35/Tyrosinase polytope
SVAPPPEEVQNILLSNAPLGPQFP

SEQ ID NO: 272 - protein, 39 aa, Artificial
  synthetic human C35/Tyrosinase polytope
QNILLSNAPLGPQFPSVAPPPEEVQNILLSNAPLGPQFP

SEQ ID NO: 273 - protein, 24 aa, Artificial
  synthetic human C35/Tyrosinase polytope
SVAPPPEEVDYSYLQDSDPDSFQD

SEQ ID NO: 274 - protein, 39 aa, Artificial
  synthetic human C35/Tyrosinase polytope
DYSYLQDSDPDSFQDSVAPPPEEVDYSYLQDSDPDSFQD

SEQ ID NO: 275 - protein, 18 aa, Artificial
  synthetic human C35/Melan-A polytope
SVAPPPEEVILTVILGVL

SEQ ID NO: 276 - protein, 27 aa, Artificial
  synthetic human C35/Melan-A polytope
ILTVILGVLSVAPPPEEVILTVILGVL

SEQ ID NO: 277 - protein, 18 aa, Artificial
  synthetic human C35/gp100 polytope
SVAPPPEEVKTWGQYWQV

SEQ ID NO: 278 - protein, 27 aa, Artificial
  synthetic human C35/gp100 polytope
KTWGQYWQVSVAPPPEEVKTWGQYWQV

SEQ ID NO: 279 - protein, 18 aa, Artificial
  synthetic human C35/gp100 polytope
SVAPPPEEVITDQVPFSV

SEQ ID NO: 280 - protein, 27 aa, Artificial
  synthetic human C35/gp100 polytope
ITDQVPFSVSVAPPPEEVITDQVPFSV

SEQ ID NO: 281 - protein, 18 aa, Artificial
  synthetic human C35/gp100 polytope
SVAPPPEEVYLEPGPVTA

SEQ ID NO: 282 - protein, 27 aa, Artificial
  synthetic human C35/gp100 polytope
YLEPGPVTASVAPPPEEVYLEPGPVTA

SEQ ID NO: 283 - protein, 19 aa, Artificial
  synthetic human C35/gp100 polytope
SVAPPPEEVLLDGTATLRL

SEQ ID NO: 284 - protein, 29 aa, Artificial
  synthetic human C35/gp100 polytope
LLDGTATLRLSVAPPPEEVLLDGTATLRL

SEQ ID NO: 285 - protein, 19 aa, Artificial
  synthetic human C35/gp100 polytope
SVAPPPEEVVLYRYGSFSV

SEQ ID NO: 286 - protein, 29 aa, Artificial
  synthetic human C35/gp100 polytope
VLYRYGSFSVSVAPPPEEVVLYRYGSFSV

SEQ ID NO: 287 - protein, 18 aa, Artificial
  synthetic human C35/PRAME polytope
SVAPPPEEVLYVDSLFFL

SEQ ID NO: 288 - protein, 27 aa, Artificial
  synthetic human C35/PRAME polytope
LYVDSLFFLSVAPPPEEVLYVDSLFFL

SEQ ID NO: 289 - protein, 21 aa, Artificial
  synthetic human C35/MAGE-6 polytope
SVAPPPEEVKISGGPRISYPL

SEQ ID NO: 290 - protein, 33 aa, Artificial
  synthetic human C35/MAGE-6 polytope
KISGGPRISYPLSVAPPPEEVKISGGPRISYPL

SEQ ID NO: 291 - protein, 20 aa, Artificial
  synthetic human C35/NY-ESO-1 polytope
SVAPPPEEVSLLMWITQCFL

SEQ ID NO: 292 - protein, 31 aa, Artificial
  synthetic human C35/NY-ESO-1 polytope
SLLMWITQCFLSVAPPPEEVSLLMWITQCFL

SEQ ID NO: 293 - protein, 18 aa, Artificial
  synthetic human C35/NY-ESO-1 polytope
SVAPPPEEVSLLMWITQC

SEQ ID NO: 294 - protein, 27 aa, Artificial
  synthetic human C35/NY-ESO-1 polytope
SLLMWITQCSVAPPPEEVSLLMWITQC

SEQ ID NO: 295 - protein, 18 aa, Artificial
  synthetic human C35/NY-ESO-1 polytope
SVAPPPEEVQLSLLMWIT

SEQ ID NO: 296 - protein, 27 aa, Artificial
  synthetic human C35/NY-ESO-1 polytope
QLSLLMWITSVAPPPEEVQLSLLMWIT

SEQ ID NO: 297 - protein, 38 aa, Artificial
  synthetic human C35/NY-ESO-1/MAGE-3 polytope
SLLMWITQCFLPVFSVAPPPEEVTSYVKVLHHMVKISG

SEQ ID NO: 298 - protein, 18 aa, Artificial
  synthetic human C35/MAGE-1 polytope
SGVRIVVEYEADPTGHSY

SEQ ID NO: 299 - protein, 27 aa, Artificial
  synthetic human C35/MAGE-1 polytope
EADPTGHSYSGVRIVVEYEADPTGHSY

SEQ ID NO: 300 - protein, 18 aa, Artificial
  synthetic human C35/MAGE-1 polytope
SGVRIVVEYSAYGEPRKL

SEQ ID NO: 301 - protein, 27 aa, Artificial
  synthetic human C35/MAGE-1 polytope
SAYGEPRKLSGVRIVVEYSAYGEPRKL

SEQ ID NO: 302 - protein, 18 aa, Artificial
  synthetic human C35/MAGE-3 polytope
SGVRIVVEYEVDPIGHLY

SEQ ID NO: 303 - protein, 27 aa, Artificial
  synthetic human C35/MAGE-3 polytope
EVDPIGHLYSGVRIVVEYEVDPIGHLY

SEQ ID NO: 304 - protein, 18 aa, Artificial
  synthetic human C35/MAGE-3 polytope
SGVRIVVEYFLWGPRALV

SEQ ID NO: 305 - protein, 27 aa, Artificial
  synthetic human C35/MAGE-3 polytope
FLWGPRALVSGVRIVVEYFLWGPRALV

SEQ ID NO: 306 - protein, 19 aa, Artificial
  synthetic human C35/MAGE-3 polytope
SGVRIVVEYMEVDPIGHLY

SEQ ID NO: 307 - protein, 29 aa, Artificial
  synthetic human C35/MAGE-3 polytope
MEVDPIGHLYSGVRIVVEYMEVDPIGHLY

SEQ ID NO: 308 - protein, 18 aa, Artificial
  synthetic human C35/BAGE polytope
SGVRIVVEYAARAVFLAL

SEQ ID NO: 309 - protein, 27 aa, Artificial
  synthetic human C35/BAGE polytope
AARAVFLALSGVRIVVEYAARAVFLAL

SEQ ID NO: 310 - protein, 17 aa, Artificial
  synthetic human C35/GAGE-1,2 polytope
SGVRIVVEYYRPRPRRY

SEQ ID NO: 311 - protein, 25 aa, Artificial
  synthetic human C35/GAGE-1,2 polytope
YRPRPRRYSGVRIVVEYYRPRPRRY

SEQ ID NO: 312 - protein, 19 aa, Artificial
  synthetic human C35/RAGE polytope
SGVRIVVEYSPSSNRIRNT

SEQ ID NO: 313 - protein, 29 aa, Artificial
  synthetic human C35/RAGE polytope
SPSSNRIRNTSGVRIVVEYSPSSNRIRNT

SEQ ID NO: 314 - protein, 19 aa, Artificial
  synthetic human C35/CDK4 polytope
SGVRIVVEYACDPHSGHFV

SEQ ID NO: 315 - protein, 29 aa, Artificial
  synthetic human C35/CDK4 polytope
ACDPHSGHFVSGVRIVVEYACDPHSGHFV

SEQ ID NO: 316 - protein, 18 aa, Artificial
  synthetic human C35/beta-catenin polytope
SGVRIVVEYSYLDSGIHF

SEQ ID NO: 317 - protein, 27 aa, Artificial
  synthetic human C35/beta-catenin polytope
SYLDSGIHFSGVRIVVEYSYLDSGIHF

SEQ ID NO: 318 - protein, 18 aa, Artificial
  synthetic human C35/tyrosinase polytope
SGVRIVVEYMLLAVLYCL

SEQ ID NO: 319 - protein, 27 aa, Artificial
  synthetic human C35/tyrosinase polytope
MLLAVLYCLSGVRIVVEYMLLAVLYCL

SEQ ID NO: 320 - protein, 18 aa, Artificial
  synthetic human C35/tyrosinase polytope
SGVRIVVEYAFLPWHRLF

SEQ ID NO: 321 - protein, 27 aa, Artificial
  synthetic human C35/tyrosinase polytope
AFLPWHRLFSGVRIVVEYAFLPWHRLF

SEQ ID NO: 322 - protein, 24 aa, Artificial
  synthetic human C35/tyrosinase polytope
SGVRIVVEYQNILLSNAPLGPQFP

SEQ ID NO: 323 - protein, 39 aa, Artificial
  synthetic human C35/tyrosinase polytope
QNILLSNAPLGPQFPSGVRIVVEYQNILLSNAPLGPQFP

SEQ ID NO: 324 - protein, 24 aa, Artificial
  synthetic human C35/tyrosinase polytope
SGVRIVVEYDYSYLQDSDPDSFQD

SEQ ID NO: 325 - protein, 39 aa, Artificial
  synthetic human C35/tyrosinase polytope
DYSYLQDSDPDSFQDSGVRIVVEYDYSYLQDSDPDSFQD

SEQ ID NO: 326 - protein, 18 aa, Artificial
  synthetic human C35/Melan-A polytope
SGVRIVVEYILTVILGVL

SEQ ID NO: 327 - protein, 27 aa, Artificial
  synthetic human C35/Melan-A polytope
ILTVILGVLSGVRIVVEYILTVILGVL

SEQ ID NO: 328 - protein, 18 aa, Artificial
  synthetic human C35/gp100 polytope
SGVRIVVEYKTWGQYWQV

SEQ ID NO: 329 - protein, 27 aa, Artificial
  synthetic human C35/gp100 polytope
KTWGQYWQVSGVRIVVEYKTWGQYWQV

SEQ ID NO: 330 - protein, 18 aa, Artificial
  synthetic human C35/gp100 polytope
SGVRIVVEYITDQVPFSV

SEQ ID NO: 331 - protein, 27 aa, Artificial
  synthetic human C35/gp100 polytope
ITDQVPFSVSGVRIVVEYITDQVPFSV

SEQ ID NO: 332 - protein, 18 aa, Artificial
  synthetic human C35/gp100 polytope
SGVRIVVEYYLEPGPVTA

SEQ ID NO: 333 - protein, 27 aa, Artificial
  synthetic human C35/gp100 polytope
YLEPGPVTASGVRIVVEYYLEPGPVTA

SEQ ID NO: 334 - protein, 19 aa, Artificial
  synthetic human C35/gp100 polytope
SGVRIVVEYLLDGTATLRL

SEQ ID NO: 335 - protein, 29 aa, Artificial
  synthetic human C35/gp100 polytope
LLDGTATLRLSGVRIVVEYLLDGTATLRL

SEQ ID NO: 336 - protein, 19 aa, Artificial
  synthetic human C35/gp100 polytope
SGVRIVVEYVLYRYGSFSV

SEQ ID NO: 337 - protein, 29 aa, Artificial
  synthetic human C35/gp100 polytope
VLYRYGSFSVSGVRIVVEYVLYRYGSFSV

SEQ ID NO: 338 - protein, 18 aa, Artificial
  synthetic human C35/PRAME polytope
SGVRIVVEYLYVDSLFFL

SEQ ID NO: 339 - protein, 27 aa, Artificial
  synthetic human C35/PRAME polytope
LYVDSLFFLSGVRIVVEYLYVDSLFFL

SEQ ID NO: 340 - protein, 21 aa, Artificial
  synthetic human C35/MAGE-6 polytope
SGVRIVVEYKISGGPRISYPL

SEQ ID NO: 341 - protein, 33 aa, Artificial
  synthetic human C35/MAGE-6 polytope
KISGGPRISYPLSGVRIVVEYKISGGPRISYPL

SEQ ID NO: 342 - protein, 20 aa, Artificial
  synthetic human C35/NY-ESO-1 polytope
SGVRIVVEYSLLMWITQCFL

SEQ ID NO: 343 - protein, 31 aa, Artificial
  synthetic human C35/NY-ESO-1 polytope
SLLMWITQCFLSGVRIVVEYSLLMWITQCFL

SEQ ID NO: 344 - protein, 18 aa, Artificial
  synthetic human C35/NY-ESO-1 polytope
SGVRIVVEYSLLMWITQC

SEQ ID NO: 345 - protein, 27 aa, Artificial
  synthetic human C35/NY-ESO-1 polytope
SLLMWITQCSGVRIVVEYSLLMWITQC

SEQ ID NO: 346 - protein, 18 aa, Artificial
  synthetic human C35/NY-ESO-1 polytope
SGVRIVVEYQLSLLMWIT

SEQ ID NO: 347 - protein, 27 aa, Artificial
  synthetic human C35/NY-ESO-1 polytope
QLSLLMWITSGVRIVVEYQLSLLMWIT

SEQ ID NO: 348 - protein, 38 aa, Artificial
  synthetic human C35/NY-ESO-1/MAGE-3 polytope
SLLMWITQCFLPVFSGVRIVVEYTSYVKVLHHMVKISG

SEQ ID NO: 349 - protein, 18 aa, Artificial
  synthetic human C35/MAGE-1 polytope
GVRIVVEYCEADPTGHSY

SEQ ID NO: 350 - protein, 27 aa, Artificial
  synthetic human C35/MAGE-1 polytope
EADPTGHSYGVRIVVEYCEADPTGHSY

SEQ ID NO: 351 - protein, 18 aa, Artificial
  synthetic human C35/MAGE-1 polytope
GVRIVVEYCSAYGEPRKL

SEQ ID NO: 352 - protein, 27 aa, Artificial
  synthetic human C35/MAGE-1 polytope
SAYGEPRKLGVRIVVEYCSAYGEPRKL

SEQ ID NO: 353 - protein, 18 aa, Artificial
  synthetic human C35/MAGE-3 polytope
GVRIVVEYCEVDPIGHLY

SEQ ID NO: 354 - protein, 27 aa, Artificial
  synthetic human C35/MAGE-3 polytope
EVDPIGHLYGVRIVVEYCEVDPIGHLY

SEQ ID NO: 355 - protein, 18 aa, Artificial
  synthetic human C35/MAGE-3 polytope
GVRIVVEYCFLWGPRALV

SEQ ID NO: 356 - protein, 26 aa, Artificial
  synthetic human C35/MAGE-3 polytope
FLWGPRALVGVRIVVEYCFLWGPRAL

SEQ ID NO: 357 - protein, 19 aa, Artificial
  synthetic human C35/MAGE-3 polytope
GVRIVVEYCMEVDPIGHLY

SEQ ID NO: 358 - protein, 29 aa, Artificial
  synthetic human C35/MAGE-3 polytope
MEVDPIGHLYGVRIVVEYCMEVDPIGHLY

SEQ ID NO: 359 - protein, 18 aa, Artificial
  synthetic human C35/BAGE polytope
GVRIVVEYCAARAVFLAL

SEQ ID NO: 360 - protein, 27 aa, Artificial
  synthetic human C35/BAGE polytope
AARAVFLALGVRIVVEYCAARAVFLAL

SEQ ID NO: 361 - protein, 17 aa, Artificial
  synthetic human C35/GAGE-1,2 polytope
GVRIVVEYCYRPRPRRY

SEQ ID NO: 362 - protein, 25 aa, Artificial
  synthetic human C35/GAGE-1,2 polytope
YRPRPRRYGVRIVVEYCYRPRPRRY

SEQ ID NO: 363 - protein, 19 aa, Artificial
  synthetic human C35/RAGE polytope
GVRIVVEYCSPSSNRIRNT

SEQ ID NO: 364 - protein, 29 aa, Artificial
  synthetic human C35/RAGE polytope
SPSSNRIRNTGVRIVVEYCSPSSNRIRNT

SEQ ID NO: 365 - protein, 19 aa, Artificial
  synthetic human C35/CDK4 polytope
GVRIVVEYCACDPHSGHFV

SEQ ID NO: 366 - protein, 29 aa, Artificial
  synthetic human C35/CDK4 polytope
ACDPHSGHFVGVRIVVEYCACDPHSGHFV

SEQ ID NO: 367 - protein, 18 aa, Artificial
  synthetic human C35/beta-catenin polytope
GVRIVVEYCSYLDSGIHF

SEQ ID NO: 368 - protein, 27 aa, Artificial
  synthetic human C35/beta-catenin polytope
SYLDSGIHFGVRIVVEYCSYLDSGIHF

SEQ ID NO: 369 - protein, 18 aa, Artificial
  synthetic human C35/tyrosinase polytope
GVRIVVEYCMLLAVLYCL

SEQ ID NO: 370 - protein, 27 aa, Artificial
  synthetic human C35/tyrosinase polytope
MLLAVLYCLGVRIVVEYCMLLAVLYCL

SEQ ID NO: 371 - protein, 18 aa, Artificial
  synthetic human C35/tyrosinase polytope
GVRIVVEYCAFLPWHRLF

SEQ ID NO: 372 - protein, 27 aa, Artificial
  synthetic human C35/tyrosinase polytope
AFLPWHRLFGVRIVVEYCAFLPWHRLF

SEQ ID NO: 373 - protein, 24 aa, Artificial
  synthetic human C35/tyrosinase polytope
GVRIVVEYCQNILLSNAPLGPQFP

SEQ ID NO: 374 - protein, 39 aa, Artificial
  synthetic human C35/tyrosinase polytope
QNILLSNAPLGPQFPGVRIVVEYCQNILLSNAPLGPQFP

SEQ ID NO: 375 - protein, 24 aa, Artificial
  synthetic human C35/tyrosinase polytope
GVRIVVEYCDYSYLQDSDPDSFQD

SEQ ID NO: 376 - protein, 39 aa, Artificial
  synthetic human C35/tyrosinase polytope
DYSYLQDSDPDSFQDGVRIVVEYCDYSYLQDSDPDSFQD

SEQ ID NO: 377 - protein, 18 aa, Artificial
  synthetic human C35/Melan-A polytope
GVRIVVEYCILTVILGVL

SEQ ID NO: 378 - protein, 27 aa, Artificial
  synthetic human C35/Melan-A polytope
ILTVILGVLGVRIVVEYCILTVILGVL

SEQ ID NO: 379 - protein, 18 aa, Artificial
  synthetic human C35/gp100 polytope
GVRIVVEYCKTWGQYWQV

SEQ ID NO: 380 - protein, 27 aa, Artificial
  synthetic human C35/gp100 polytope
KTWGQYWQVGVRIVVEYCKTWGQYWQV

SEQ ID NO: 381 - protein, 18 aa, Artificial
  synthetic human C35/gp100 polytope
GVRIVVEYCITDQVPFSV

SEQ ID NO: 382 - protein, 27 aa, Artificial
  synthetic human C35/gp100 polytope
ITDQVPFSVGVRIVVEYCITDQVPFSV

SEQ ID NO: 383 - protein, 18 aa, Artificial
  synthetic human C35/gp100 polytope
GVRIVVEYCYLEPGPVTA

SEQ ID NO: 384 - protein, 27 aa, Artificial
  synthetic human C35/gp100 polytope
YLEPGPVTAGVRIVVEYCYLEPGPVTA

SEQ ID NO: 385 - protein, 19 aa, Artificial
  synthetic human C35/gp100 polytope
GVRIVVEYCLLDGTATLRL

SEQ ID NO: 386 - protein, 29 aa, Artificial
  synthetic human C35/gp100 polytope
LLDGTATLRLGVRIVVEYCLLDGTATLRL

SEQ ID NO: 387 - protein, 19 aa, Artificial
  synthetic human C35/gp100 polytope
GVRIVVEYCVLYRYGSFSV

SEQ ID NO: 388 - protein, 29 aa, Artificial
  synthetic human C35/gp100 polytope
VLYRYGSFSVGVRIVVEYCVLYRYGSFSV

SEQ ID NO: 389 - protein, 18 aa, Artificial
  synthetic human C35/PRAME polytope
GVRIVVEYCLYVDSLFFL

SEQ ID NO: 390 - protein, 27 aa, Artificial
  synthetic human C35/PRAME polytope
LYVDSLFFLGVRIVVEYCLYVDSLFFL

SEQ ID NO: 391 - protein, 21 aa, Artificial
  synthetic human C35/MAGE-6 polytope
GVRIVVEYCKISGGPRISYPL

SEQ ID NO: 392 - protein, 33 aa, Artificial
  synthetic human C35/MAGE-6 polytope
KISGGPRISYPLGVRIVVEYCKISGGPRISYPL

SEQ ID NO: 393 - protein, 20 aa, Artificial
  synthetic human C35/NY-ESO-1 polytope
GVRIVVEYCSLLMWITQCFL

SEQ ID NO: 394 - protein, 31 aa, Artificial
  synthetic human C35/NY-ESO-1 polytope
SLLMWITQCFLGVRIVVEYCSLLMWITQCFL

SEQ ID NO: 395 - protein, 18 aa, Artificial
  synthetic human C35/NY-ESO-1 polytope
GVRIVVEYCSLLMWITQC

SEQ ID NO: 396 - protein, 27 aa, Artificial
  synthetic human C35/NY-ESO-1 polytope
SLLMWITQCGVRIVVEYCSLLMWITQC

SEQ ID NO: 397 - protein, 18 aa, Artificial
  synthetic human C35/NY-ESO-1 polytope
GVRIVVEYCQLSLLMWIT

SEQ ID NO: 398 - protein, 27 aa, Artificial
  synthetic human C35/NY-ESO-1 polytope
QLSLLMWITGVRIVVEYCQLSLLMWIT

SEQ ID NO: 399 - protein, 38 aa, Artificial
  synthetic human C35/NY-ESO-1/MAGE-3 polytope
SLLMWITQCFLPVFGVRIVVEYCTSYVKVLHHMVKISG

SEQ ID NO: 400 - protein, 18 aa, Artificial
  synthetic human C35/MAGE-1 polytope
IVVEYCEPCEADPTGHSY

SEQ ID NO: 401 - protein, 27 aa, Artificial
  synthetic human C35/MAGE-1 polytope
EADPTGHSYIVVEYCEPCEADPTGHSY

SEQ ID NO: 402 - protein, 18 aa, Artificial
  synthetic human C35/MAGE-1 polytope
IVVEYCEPCSAYGEPRKL

SEQ ID NO: 403 - protein, 27 aa, Artificial
  synthetic human C35/MAGE-1 polytope
SAYGEPRKLIVVEYCEPCSAYGEPRKL

SEQ ID NO: 404 - protein, 18 aa, Artificial
  synthetic human C35/MAGE-3 polytope
IVVEYCEPCEVDPIGHLY

SEQ ID NO: 405 - protein, 27 aa, Artificial
  synthetic human C35/MAGE-3 polytope
EVDPIGHLYIVVEYCEPCEVDPIGHLY

SEQ ID NO: 406 - protein, 18 aa, Artificial
  synthetic human C35/MAGE-3 polytope
IVVEYCEPCFLWGPRALV

SEQ ID NO: 407 - protein, 27 aa, Artificial
  synthetic human C35/MAGE-3 polytope
FLWGPRALVIVVEYCEPCFLWGPRALV

SEQ ID NO: 408 - protein, 19 aa, Artificial
  synthetic human C35/MAGE-3 polytope
IVVEYCEPCMEVDPIGHLY

SEQ ID NO: 409 - protein, 29 aa, Artificial
  synthetic human C35/MAGE-3 polytope
MEVDPIGHLYIVVEYCEPCMEVDPIGHLY

SEQ ID NO: 410 - protein, 18 aa, Artificial
  synthetic human C35/BAGE polytope
IVVEYCEPCAARAVFLAL

SEQ ID NO: 411 - protein, 27 aa, Artificial
  synthetic human C35/BAGE polytope
AARAVFLALIVVEYCEPCAARAVFLAL

SEQ ID NO: 412 - protein, 17 aa, Artificial
  synthetic human C35/GAGE-1,2 polytope
IVVEYCEPCYRPRPRRY

SEQ ID NO: 413 - protein, 25 aa, Artificial
  synthetic human C35/GAGE-1,2 polytope
YRPRPRRYIVVEYCEPCYRPRPRRY

SEQ ID NO: 414 - protein, 19 aa, Artificial
  synthetic human C35/RAGE polytope
IVVEYCEPCSPSSNRIRNT

SEQ ID NO: 415 - protein, 29 aa, Artificial
  synthetic human C35/RAGE polytope
SPSSNRIRNTIVVEYCEPCSPSSNRIRNT

SEQ ID NO: 416 - protein, 19 aa, Artificial
  synthetic human C35/CDK4 polytope
IVVEYCEPCACDPHSGHFV

SEQ ID NO: 417 - protein, 29 aa, Artificial
  synthetic human C35/CDK4 polytope
ACDPHSGHFVIVVEYCEPCACDPHSGHFV

SEQ ID NO: 418 - protein, 18 aa, Artificial
  synthetic human C35/beta-catenin polytope
IVVEYCEPCSYLDSGIHF

SEQ ID NO: 419 - protein, 27 aa, Artificial
  synthetic human C35/beta-catenin polytope
SYLDSGIHFIVVEYCEPCSYLDSGIHF

SEQ ID NO: 420 - protein, 18 aa, Artificial
  synthetic human C35/tyrosinase polytope
IVVEYCEPCMLLAVLYCL

SEQ ID NO: 421 - protein, 27 aa, Artificial
  synthetic human C35/tyrosinase polytope
MLLAVLYCLIVVEYCEPCMLLAVLYCL

SEQ ID NO: 422 - protein, 18 aa, Artificial
  synthetic human C35/tyrosinase polytope
IVVEYCEPCAFLPWHRLF

SEQ ID NO: 423 - protein, 26 aa, Artificial
  synthetic human C35/tyrosinase polytope
AFLPWHRLFIVVEYCEPCAFLPWHRL

SEQ ID NO: 424 - protein, 24 aa, Artificial
  synthetic human C35/tyrosinase polytope
IVVEYCEPCQNILLSNAPLGPQFP

SEQ ID NO: 425 - protein, 39 aa, Artificial
  synthetic human C35/tyrosinase polytope
QNILLSNAPLGPQFPIVVEYCEPCQNILLSNAPLGPQFP

SEQ ID NO: 426 - protein, 24 aa, Artificial
  synthetic human C35/tyrosinase polytope
IVVEYCEPCDYSYLQDSDPDSFQD

SEQ ID NO: 427 - protein, 39 aa, Artificial
  synthetic human C35/tyrosinase polytope
DYSYLQDSDPDSFQDIVVEYCEPCDYSYLQDSDPDSFQD

SEQ ID NO: 428 - protein, 18 aa, Artificial
  synthetic human C35/Melan-A polytope
IVVEYCEPCILTVILGVL

SEQ ID NO: 429 - protein, 27 aa, Artificial
  synthetic human C35/Melan-A polytope
ILTVILGVLIVVEYCEPCILTVILGVL

SEQ ID NO: 430 - protein, 18 aa, Artificial
  synthetic human C35/gp100 polytope
IVVEYCEPCKTWGQYWQV

SEQ ID NO: 431 - protein, 27 aa, Artificial
  synthetic human C35/gp100 polytope
KTWGQYWQVIVVEYCEPCKTWGQYWQV

SEQ ID NO: 432 - protein, 18 aa, Artificial
  synthetic human C35/gp100 polytope
IVVEYCEPCITDQVPFSV

SEQ ID NO: 433 - protein, 27 aa, Artificial
  synthetic human C35/gp100 polytope
ITDQVPFSVIVVEYCEPCITDQVPFSV

SEQ ID NO: 434 - protein, 18 aa, Artificial
  synthetic human C35/gp100 polytope
IVVEYCEPCYLEPGPVTA

SEQ ID NO: 435 - protein, 27 aa, Artificial
  synthetic human C35/gp100 polytope
YLEPGPVTAIVVEYCEPCYLEPGPVTA

SEQ ID NO: 436 - protein, 19 aa, Artificial
  synthetic human C35/gp100 polytope
IVVEYCEPCLLDGTATLRL

SEQ ID NO: 437 - protein, 29 aa, Artificial
  synthetic human C35/gp100 polytope
LLDGTATLRLIVVEYCEPCLLDGTATLRL

SEQ ID NO: 438 - protein, 19 aa, Artificial
  synthetic human C35/gp100 polytope
IVVEYCEPCVLYRYGSFSV

SEQ ID NO: 439 - protein, 29 aa, Artificial
  synthetic human C35/gp100 polytope
VLYRYGSFSVIVVEYCEPCVLYRYGSFSV

SEQ ID NO: 440 - protein, 18 aa, Artificial
  synthetic human C35/PRAME polytope
IVVEYCEPCLYVDSLFFL

SEQ ID NO: 441 - protein, 27 aa, Artificial
  synthetic human C35/PRAME polytope
LYVDSLFFLIVVEYCEPCLYVDSLFFL

SEQ ID NO: 442 - protein, 21 aa, Artificial
  synthetic human C35/MAGE-6 polytope
IVVEYCEPCKISGGPRISYPL

SEQ ID NO: 443 - protein, 33 aa, Artificial
  synthetic human C35/MAGE-6 polytope
KISGGPRISYPLIVVEYCEPCKISGGPRISYPL

SEQ ID NO: 444 - protein, 20 aa, Artificial
  synthetic human C35/NY-ESO-1 polytope
IVVEYCEPCSLLMWITQCFL

SEQ ID NO: 445 - protein, 31 aa, Artificial
  synthetic human C35/NY-ESO-1 polytope
SLLMWITQCFLIVVEYCEPCSLLMWITQCFL

SEQ ID NO: 446 - protein, 18 aa, Artificial
  synthetic human C35/NY-ESO-1 polytope
IVVEYCEPCSLLMWITQC

SEQ ID NO: 447 - protein, 27 aa, Artificial
  synthetic human C35/NY-ESO-1 polytope
SLLMWITQCIVVEYCEPCSLLMWITQC

SEQ ID NO: 448 - protein, 18 aa, Artificial
  synthetic human C35/NY-ESO-1 polytope
IVVEYCEPCQLSLLMWIT

SEQ ID NO: 449 - protein, 28 aa, Artificial
  synthetic human C35/NY-ESO-1 polytope
QLSLLMWITIVVEYCEPCVQLSLLMWIT

SEQ ID NO: 450 - protein, 38 aa, Artificial
  synthetic human C35/NY-ESO-1/MAGE-3 polytope
SLLMWITQCFLPVFIVVEYCEPCTSYVKVLHHMVKISG

SEQ ID NO: 451 - protein, 18 aa, Artificial
  synthetic human C35/MAGE-1 polytope
TYLELASAVEADPTGHSY

SEQ ID NO: 452 - protein, 27 aa, Artificial
  synthetic human C35/MAGE-1 polytope
EADPTGHSYTYLELASAVEADPTGHSY

SEQ ID NO: 453 - protein, 18 aa, Artificial
  synthetic human C35/MAGE-1 polytope
TYLELASAVSAYGEPRKL

SEQ ID NO: 454 - protein, 27 aa, Artificial
  synthetic human C35/MAGE-1 polytope
SAYGEPRKLTYLELASAVSAYGEPRKL

SEQ ID NO: 455 - protein, 18 aa, Artificial
  synthetic human C35/MAGE-3 polytope
TYLELASAVEVDPIGHLY

SEQ ID NO: 456 - protein, 27 aa, Artificial
  synthetic human C35/MAGE-3 polytope
EVDPIGHLYTYLELASAVEVDPIGHLY

SEQ ID NO: 457 - protein, 18 aa, Artificial
  synthetic human C35/MAGE-3 polytope
TYLELASAVFLWGPRALV

SEQ ID NO: 458 - protein, 27 aa, Artificial
  synthetic human C35/MAGE-3 polytope
FLWGPRALVTYLELASAVFLWGPRALV

SEQ ID NO: 459 - protein, 19 aa, Artificial
  synthetic human C35/MAGE-3 polytope
TYLELASAVMEVDPIGHLY

SEQ ID NO: 460 - protein, 29 aa, Artificial
  synthetic human C35/MAGE-3 polytope
MEVDPIGHLYTYLELASAVMEVDPIGHLY

SEQ ID NO: 461 - protein, 18 aa, Artificial
  synthetic human C35/BAGE polytope
TYLELASAVAARAVFLAL

SEQ ID NO: 462 - protein, 27 aa, Artificial
  synthetic human C35/BAGE polytope
AARAVFLALTYLELASAVAARAVFLAL

SEQ ID NO: 463 - protein, 17 aa, Artificial
  synthetic human C35/GAGE-1,2 polytope
TYLELASAVYRPRPRRY

SEQ ID NO: 464 - protein, 25 aa, Artificial
  synthetic human C35/GAGE-1,2 polytope
YRPRPRRYTYLELASAVYRPRPRRY

SEQ ID NO: 465 - protein, 19 aa, Artificial
  synthetic human C35/RAGE polytope
TYLELASAVSPSSNRIRNT

SEQ ID NO: 466 - protein, 29 aa, Artificial
  synthetic human C35/RAGE polytope
SPSSNRIRNTTYLELASAVSPSSNRIRNT

SEQ ID NO: 467 - protein, 19 aa, Artificial
  synthetic human C35/CDK4 polytope
TYLELASAVACDPHSGHFV

SEQ ID NO: 468 - protein, 29 aa, Artificial
  synthetic human C35/CDK4 polytope
ACDPHSGHFVTYLELASAVACDPHSGHFV

SEQ ID NO: 469 - protein, 18 aa, Artificial
  synthetic human C35/beta-catenin polytope
TYLELASAVSYLDSGIHF

SEQ ID NO: 470 - protein, 27 aa, Artificial
  synthetic human C35/beta-catenin polytope
SYLDSGIHFTYLELASAVSYLDSGIHF

SEQ ID NO: 471 - protein, 18 aa, Artificial
  synthetic human C35/tyrosinase polytope
TYLELASAVMLLAVLYCL

SEQ ID NO: 472 - protein, 27 aa, Artificial
  synthetic human C35/tyrosinase polytope
MLLAVLYCLTYLELASAVMLLAVLYCL

SEQ ID NO: 473 - protein, 18 aa, Artificial
  synthetic human C35/tyrosinase polytope
TYLELASAVAFLPWHRLF

SEQ ID NO: 474 - protein, 27 aa, Artificial
  synthetic human C35/tyrosinase polytope
AFLPWHRLFTYLELASAVAFLPWHRLF

SEQ ID NO: 475 - protein, 24 aa, Artificial
  synthetic human C35/tyrosinase polytope
TYLELASAVQNILLSNAPLGPQFP

SEQ ID NO: 476 - protein, 39 aa, Artificial
  synthetic human C35/tyrosinase polytope
QNILLSNAPLGPQFPTYLELASAVQNILLSNAPLGPQFP

SEQ ID NO: 477 - protein, 24 aa, Artificial
  synthetic human C35/tyrosinase polytope
TYLELASAVDYSYLQDSDPDSFQD

SEQ ID NO: 478 - protein, 39 aa, Artificial
  synthetic human C35/tyrosinase polytope
DYSYLQDSDPDSFQDTYLELASAVDYSYLQDSDPDSFQD

SEQ ID NO: 479 - protein, 18 aa, Artificial
  synthetic human C35/Melan-A polytope
TYLELASAVILTVILGVL

SEQ ID NO: 480 - protein, 27 aa, Artificial
  synthethic human C35/Melan-A polytope
ILTVILGVLTYLELASAVILTVILGVL

SEQ ID NO: 481 - protein, 18 aa, Artificial
  synthetic human C35/gp100 polytope
TYLELASAVKTWGQYWQV

SEQ ID NO: 482 - protein, 27 aa, Artificial
  synthetic human C35/gp100 polytope
KTWGQYWQVTYLELASAVKTWGQYWQV

SEQ ID NO: 483 - protein, 18 aa, Artificial
  synthetic human C35/gp100 polytope
TYLELASAVITDQVPFSV

SEQ ID NO: 484 - protein, 27 aa, Artificial
  synthetic human C35/gp100 polytope
ITDQVPFSVTYLELASAVITDQVPFSV

SEQ ID NO: 485 - protein, 18 aa, Artificial
  synthetic human C35/gp100 polytope
TYLELASAVYLEPGPVTA

SEQ ID NO: 486 - protein, 27 aa, Artificial
  synthetic human C35/gp100 polytope
YLEPGPVTATYLELASAVYLEPGPVTA

SEQ ID NO: 487 - protein, 19 aa, Artificial
  synthetic human C35/gp100 polytope
TYLELASAVLLDGTATLRL

SEQ ID NO: 488 - protein, 29 aa, Artificial
  synthetic human C35/gp100 polytope
LLDGTATLRLTYLELASAVLLDGTATLRL

SEQ ID NO: 489 - protein, 19 aa, Artificial
  synthetic human C35/gp100 polytope
TYLELASAVVLYRYGSFSV

SEQ ID NO: 490 - protein, 29 aa, Artificial
  synthetic human C35/gp100 polytope
VLYRYGSFSVTYLELASAVVLYRYGSFSV

SEQ ID NO: 491 - protein, 18 aa, Artificial
  synthetic human C35/PRAME polytope
TYLELASAVLYVDSLFFL

SEQ ID NO: 492 - protein, 27 aa, Artificial
  synthetic human C35/PRAME polytope
LYVDSLFFLTYLELASAVLYVDSLFFL

SEQ ID NO: 493 - protein, 21 aa, Artificial
  synthetic human C35/MAGE-6 polytope
TYLELASAVKISGGPRISYPL

SEQ ID NO: 494 - protein, 33 aa, Artificial
  synthetic human C35/MAGE-6 polytope
KISGGPRISYPLTYLELASAVKISGGPRISYPL

SEQ ID NO: 495 - protein, 20 aa, Artificial
  synthetic human C35/NY-ESO-1 polytope
TYLELASAVSLLMWITQCFL

SEQ ID NO: 496 - protein, 31 aa, Artificial
  synthetic human C35/NY-ESO-1 polytope
SLLMWITQCFLTYLELASAVSLLMWITQCFL

SEQ ID NO: 497 - protein, 18 aa, Artificial
  synthetic human C35/NY-ESO-1 polytope
TYLELASAVSLLMWITQC

SEQ ID NO: 498 - protein, 27 aa, Artificial
  synthetic human C35/NY-ESO-1 polytope
SLLMWITQCTYLELASAVSLLMWITQC

SEQ ID NO: 499 - protein, 18 aa, Artificial
  synthetic human C35/NY-ESO-1 polytope
TYLELASAVQLSLLMWIT

SEQ ID NO: 500 - protein, 27 aa, Artificial
  synthetic human C35/NY-ESO-1 polytope
QLSLLMWITTYLELASAVQLSLLMWIT

SEQ ID NO: 501 - protein, 38 aa, Artificial
  synthetic human C35/NY-ESO-1/MAGE-3 polytope
SLLMWITQCFLPVFTYLELASAVTSYVKVLHHMVKISG

SEQ ID NO: 502 - protein, 18 aa, Artificial
  synthetic human C35/MAGE-1 polytope
GTGAFEIEIEADPTGHSY

SEQ ID NO: 503 - protein, 27 aa, Artificial
  synthetic human C35/MAGE-1 polytope
EADPTGHSYGTGAFEIEIEADPTGHSY

SEQ ID NO: 504 - protein, 18 aa, Artificial
  synthetic human C35/MAGE-1 polytope
GTGAFEIEISAYGEPRKL

SEQ ID NO: 505 - protein, 27 aa, Artificial
  synthetic human C35/MAGE-1 polytope
SAYGEPRKLGTGAFEIEISAYGEPRKL

SEQ ID NO: 506 - protein, 18 aa, Artificial
  synthetic human C35/MAGE-3 polytope
GTGAFEIEIEVDPIGHLY

SEQ ID NO: 507 - protein, 27 aa, Artificial
  synthetic human C35/MAGE-3 polytope
EVDPIGHLYGTGAFEIEIEVDPIGHLY

SEQ ID NO: 508 - protein, 18 aa, Artificial
  synthetic human C35/MAGE-3 polytope
GTGAFEIEIFLWGPRALV

SEQ ID NO: 509 - protein, 27 aa, Artificial
  synthetic human C35/MAGE-3 polytope
FLWGPRALVGTGAFEIEIFLWGPRALV

SEQ ID NO: 510 - protein, 19 aa, Artificial
  synthetic human C35/MAGE-3 polytope
GTGAFEIEIMEVDPIGHLY

SEQ ID NO: 511 - protein, 29 aa, Artificial
  synthetic human C35/MAGE-3 polytope
MEVDPIGHLYGTGAFEIEIMEVDPIGHLY

SEQ ID NO: 512 - protein, 18 aa, Artificial
  synthetic human C35/BAGE polytope
GTGAFEIEIAARAVFLAL

SEQ ID NO: 513 - protein, 27 aa, Artificial
  synthetic human C35/BAGE polytope
AARAVFLALGTGAFEIEIAARAVFLAL

SEQ ID NO: 514 - protein, 17 aa, Artificial
  synthetic human C35/GAGE-1,2 polytope
GTGAFEIEIYRPRPRRY

SEQ ID NO: 515 - protein, 25 aa, Artificial
  synthetic human C35/GAGE-1,2 polytope
YRPRPRRYGTGAFEIEIYRPRPRRY

SEQ ID NO: 516 - protein, 19 aa, Artificial
  synthetic human C35/RAGE polytope
GTGAFEIEISPSSNRIRNT

SEQ ID NO: 517 - protein, 29 aa, Artificial
  synthetic human C35/RAGE polytope
SPSSNRIRNTGTGAFEIEISPSSNRIRNT

SEQ ID NO: 518 - protein, 19 aa, Artificial
  synthetic human C35/CDK4 polytope
GTGAFEIEIACDPHSGHFV

SEQ ID NO: 519 - protein, 29 aa, Artificial
  synthetic human C35/CDK4 polytope
ACDPHSGHFVGTGAFEIEIACDPHSGHFV

SEQ ID NO: 520 - protein, 18 aa, Artificial
  synthetic human C35/beta-catenin polytope
GTGAFEIEISYLDSGIHF

SEQ ID NO: 521 - protein, 27 aa, Artificial
  synthetic human C35/beta-catenin polytope
SYLDSGIHFGTGAFEIEISYLDSGIHF

SEQ ID NO: 522 - protein, 18 aa, Artificial
  synthetic human C35/tyrosinase polytope
GTGAFEIEIMLLAVLYCL

SEQ ID NO: 523 - protein, 27 aa, Artificial
  synthetic human C35/tyrosinase polytope
MLLAVLYCLGTGAFEIEIMLLAVLYCL

SEQ ID NO: 524 - protein, 18 aa, Artificial
  synthetic human C35/tyrosinase polytope
GTGAFEIEIAFLPWHRLF

SEQ ID NO: 525 - protein, 27 aa, Artificial
  synthetic human C35/tyrosinase polytope
AFLPWHRLFGTGAFEIEIAFLPWHRLF

SEQ ID NO: 526 - protein, 24 aa, Artificial
  synthetic human C35/tyrosinase polytope
GTGAFEIEIQNILLSNAPLGPQFP

SEQ ID NO: 527 - protein, 39 aa, Artificial
  synthetic human C35/tyrosinase polytope
QNILLSNAPLGPQFPGTGAFEIEIQNILLSNAPLGPQFP

SEQ ID NO: 528 - protein, 24 aa, Artificial
  synthetic human C35/tyrosinase polytope
GTGAFEIEIDYSYLQDSDPDSFQD

SEQ ID NO: 529 - protein, 39 aa, Artificial
  synthetic human C35/tyrosinase polytope
DYSYLQDSDPDSFQDGTGAFEIEIDYSYLQDSDPDSFQD

SEQ ID NO: 530 - protein, 18 aa, Artificial
  synthetic human C35/Melan-A polytope
GTGAFEIEIILTVILGVL

SEQ ID NO: 531 - protein, 27 aa, Artificial
  synthetic human C35/Melan-A polytope
ILTVILGVLGTGAFEIEIILTVILGVL

SEQ ID NO: 532 - protein, 18 aa, Artificial
  synthetic human C35/gp100 polytope
GTGAFEIEIKTWGQYWQV

SEQ ID NO: 533 - protein, 27 aa, Artificial
  synthetic human C35/gp100 polytope
KTWGQYWQVGTGAFEIEIKTWGQYWQV

SEQ ID NO: 534 - protein, 18 aa, Artificial
  synthetic human C35/gp100 polytope
GTGAFEIEIITDQVPFSV

SEQ ID NO: 535 - protein, 27 aa, Artificial
  synthetic human C35/gp100 polytope
ITDQVPFSVGTGAFEIEIITDQVPFSV

SEQ ID NO: 536 - protein, 18 aa, Artificial
  synthetic human C35/gp100 polytope
GTGAFEIEIYLEPGPVTA

SEQ ID NO: 537 - protein, 27 aa, Artificial
  synthetic human C35/gp100 polytope
YLEPGPVTAGTGAFEIEIYLEPGPVTA

SEQ ID NO: 538 - protein, 19 aa, Artificial
  synthetic human C35/gp100 polytope
GTGAFEIEILLDGTATLRL

SEQ ID NO: 539 - protein, 29 aa, Artificial
  synthetic human C35/gp100 polytope
LLDGTATLRLGTGAFEIEILLDGTATLRL

SEQ ID NO: 540 - protein, 19 aa, Artificial
  synthetic human C35/gp100 polytope
GTGAFEIEIVLYRYGSFSV

SEQ ID NO: 541 - protein, 29 aa, Artificial
  synthetic human C35/gp100 polytope
VLYRYGSFSVGTGAFEIEIVLYRYGSFSV

SEQ ID NO: 542 - protein, 18 aa, Artificial
  synthetic human C35/PRAME polytope
GTGAFEIEILYVDSLFFL

SEQ ID NO: 543 - protein, 27 aa, Artificial
  synthetic human C35/PRAME polytope
LYVDSLFFLGTGAFEIEILYVDSLFFL

SEQ ID NO: 544 - protein, 21 aa, Artificial
  synthetic human C35/MAGE-6 polytope
GTGAFEIEIKISGGPRISYPL

SEQ ID NO: 545 - protein, 33 aa, Artificial
  synthetic human C35/MAGE-6 polytope
KISGGPRISYPLGTGAFEIEIKISGGPRISYPL

SEQ ID NO: 546 - protein, 20 aa, Artificial
  synthetic human C35/NY-ESO-1 polytope
GTGAFEIEISLLMWITQCFL

SEQ ID NO: 547 - protein, 31 aa, Artificial
  synthetic human C35/NY-ESO-1 polytope
SLLMWITQCFLGTGAFEIEISLLMWITQCFL

SEQ ID NO: 548 - protein, 18 aa, Artificial
  synthetic human C35/NY-ESO-1 polytope
GTGAFEIEISLLMWITQC

SEQ ID NO: 549 - protein, 27 aa, Artificial
  synthetic human C35/NY-ESO-1 polytope
SLLMWITQCGTGAFEIEISLLMWITQC

SEQ ID NO: 550 - protein, 18 aa, Artificial
  synthetic human C35/NY-ESO-1 polytope
GTGAFEIEIQLSLLMWIT

SEQ ID NO: 551 - protein, 27 aa, Artificial
  synthetic human C35/NY-ESO-1 polytope
QLSLLMWITGTGAFEIEIQLSLLMWIT

SEQ ID NO: 552 - protein, 38 aa, Artificial
  synthetic human C35/NY-ESO-1/MAGE-3 polytope
SLLMWITQCFLPVFGTGAFEIEITSYVKVLHHMVKISG

SEQ ID NO: 553 - protein, 18 aa, Artificial
  synthetic human C35/MAGE-1 polytope
FEIEINGQLEADPTGHSY

SEQ ID NO: 554 - protein, 27 aa, Artificial
  synthetic human C35/MAGE-1 polytope
EADPTGHSYFEIEINGQLEADPTGHSY

SEQ ID NO: 555 - protein, 18 aa, Artificial
  synthetic human C35/MAGE-1 polytope
FEIEINGQLSAYGEPRKL

SEQ ID NO: 556 - protein, 27 aa, Artificial
  synthetic human C35/MAGE-1 polytope
SAYGEPRKLFEIEINGQLSAYGEPRKL

SEQ ID NO: 557 - protein, 18 aa, Artificial
  synthetic human C35/MAGE-3 polytope
FEIEINGQLEVDPIGHLY

SEQ ID NO: 558 - protein, 27 aa, Artificial
  synthetic human C35/MAGE-3 polytope
EVDPIGHLYFEIEINGQLEVDPIGHLY

SEQ ID NO: 559 - protein, 18 aa, Artificial
  synthetic human C35/MAGE-3 polytope
FEIEINGQLFLWGPRALV

SEQ ID NO: 560 - protein, 27 aa, Artificial
  synthetic human C35/MAGE-3 polytope
FLWGPRALVFEIEINGQLFLWGPRALV

SEQ ID NO: 561 - protein, 19 aa, Artificial
  synthetic human C35/MAGE-3 polytope
FEIEINGQLMEVDPIGHLY

SEQ ID NO: 562 - protein, 29 aa, Artificial
  synthetic human C35/MAGE-3 polytope
MEVDPIGHLYFEIEINGQLMEVDPIGHLY

SEQ ID NO: 563 - protein, 18 aa, Artificial
  synthetic human C35/BAGE polytope
FEIEINGQLAARAVFLAL

SEQ ID NO: 564 - protein, 27 aa, Artificial
  synthetic human C35/BAGE polytope
AARAVFLALFEIEINGQLAARAVFLAL

SEQ ID NO: 565 - protein, 17 aa, Artificial
  synthetic human C35/GAGE-1,2 polytope
FEIEINGQLYRPRPRRY

SEQ ID NO: 566 - protein, 25 aa, Artificial
  synthetic human C35/GAGE-1,2 polytope
YRPRPRRYFEIEINGQLYRPRPRRY

SEQ ID NO: 567 - protein, 19 aa, Artificial
  synthetic human C35/RAGE polytope
FEIEINGQLSPSSNRIRNT

SEQ ID NO: 568 - protein, 29 aa, Artificial
  synthetic human C35/RAGE polytope
SPSSNRIRNTFEIEINGQLSPSSNRIRNT

SEQ ID NO: 569 - protein, 19 aa, Artificial
  synthetic human C35/CDK4 polytope
FEIEINGQLACDPHSGHFV

SEQ ID NO: 570 - protein, 29 aa, Artificial
  synthetic human C35/CDK4 polytope
ACDPHSGHFVFEIEINGQLACDPHSGHFV

SEQ ID NO: 571 - protein, 18 aa, Artificial
  synthetic human C35/beta-catenin polytope
FEIEINGQLSYLDSGIHF

SEQ ID NO: 572 - protein, 27 aa, Artificial
  synthetic human C35/beta-catenin polytope
SYLDSGIHFFEIEINGQLSYLDSGIHF

SEQ ID NO: 573 - protein, 18 aa, Artificial
  synthetic human C35/tyrosinase poytope
FEIEINGQLMLLAVLYCL

SEQ ID NO: 574 - protein, 27 aa, Artificial
  synthetic human C35/tyrosinase poytope
MLLAVLYCLFEIEINGQLMLLAVLYCL

SEQ ID NO: 575 - protein, 18 aa, Artificial
  synthetic human C35/tyrosinase poytope
FEIEINGQLAFLPWHRLF

SEQ ID NO: 576 - protein, 27 aa, Artificial
  synthetic human C35/tyrosinase poytope
AFLPWHRLFFEIEINGQLAFLPWHRLF

SEQ ID NO: 577 - protein, 24 aa, Artificial
  synthetic human C35/tyrosinase poytope
FEIEINGQLQNILLSNAPLGPQFP

SEQ ID NO: 578 - protein, 39 aa, Artificial
  synthetic human C35/tyrosinase poytope
QNILLSNAPLGPQFPFEIEINGQLQNILLSNAPLGPQFP

SEQ ID NO: 579 - protein, 24 aa, Artificial
  synthetic human C35/tyrosinase poytope
FEIEINGQLDYSYLQDSDPDSFQD

SEQ ID NO: 580 - protein, 39 aa, Artificial
  synthetic human C35/tyrosinase poytope
DYSYLQDSDPDSFQDFEIEINGQLDYSYLQDSDPDSFQD

SEQ ID NO: 581 - protein, 18 aa, Artificial
  synthetic human C35/Melan-A polytope
FEIEINGQLILTVILGVL

SEQ ID NO: 582 - protein, 27 aa, Artificial
  synthetic human C35/Melan-A polytope
ILTVILGVLFEIEINGQLILTVILGVL

SEQ ID NO: 583 - protein, 18 aa, Artificial
  synthetic human C35/gp100 polytope
FEIEINGQLKTWGQYWQV

SEQ ID NO: 584 - protein, 27 aa, Artificial
  synthetic human C35/gp100 polytope
KTWGQYWQVFEIEINGQLKTWGQYWQV

SEQ ID NO: 585 - protein, 18 aa, Artificial
  synthetic human C35/gp100 polytope
FEIEINGQLITDQVPFSV

SEQ ID NO: 586 - protein, 27 aa, Artificial
  synthetic human C35/gp100 polytope
ITDQVPFSVFEIEINGQLITDQVPFSV

SEQ ID NO: 587 - protein, 18 aa, Artificial
  synthetic human C35/gp100 polytope
FEIEINGQLYLEPGPVTA

SEQ ID NO: 588 - protein, 27 aa, Artificial
  synthetic human C35/gp100 polytope
YLEPGPVTAFEIEINGQLYLEPGPVTA

SEQ ID NO: 589 - protein, 19 aa, Artificial
  synthetic human C35/gp100 polytope
FEIEINGQLLLDGTATLRL

SEQ ID NO: 590 - protein, 29 aa, Artificial
  synthetic human C35/gp100 polytope
LLDGTATLRLFEIEINGQLLLDGTATLRL

SEQ ID NO: 591 - protein, 19 aa, Artificial
  synthetic human C35/gp100 polytope
FEIEINGQLVLYRYGSFSV

SEQ ID NO: 592 - protein, 29 aa, Artificial
  synthetic human C35/gp100 polytope
VLYRYGSFSVFEIEINGQLVLYRYGSFSV

SEQ ID NO: 593 - protein, 18 aa, Artificial
  synthetic human C35/PRAME polytope
FEIEINGQLLYVDSLFFL

SEQ ID NO: 594 - protein, 27 aa, Artificial
  synthetic human C35/PRAME polytope
LYVDSLFFLFEIEINGQLLYVDSLFFL

SEQ ID NO: 595 - protein, 21 aa, Artificial
  synthetic human C35/MAGE-6 polytope
FEIEINGQLKISGGPRISYPL

SEQ ID NO: 596 - protein, 33 aa, Artificial
  synthetic human C35/MAGE-6 polytope
KISGGPRISYPLFEIEINGQLKISGGPRISYPL

SEQ ID NO: 597 - protein, 20 aa, Artificial
  synthetic human C35/NY-ESO-1 polytope
FEIEINGQLSLLMWITQCFL

SEQ ID NO: 598 - protein, 31 aa, Artificial
  synthetic human C35/NY-ESO-1 polytope
SLLMWITQCFLFEIEINGQLSLLMWITQCFL

SEQ ID NO: 599 - protein, 18 aa, Artificial
  synthetic human C35/NY-ESO-1 polytope
FEIEINGQLSLLMWITQC

SEQ ID NO: 600 - protein, 27 aa, Artificial
  synthetic human C35/NY-ESO-1 polytope
SLLMWITQCFEIEINGQLSLLMWITQC

SEQ ID NO: 601 - protein, 18 aa, Artificial
  synthetic human C35/NY-ESO-1 polytope
FEIEINGQLQLSLLMWIT

SEQ ID NO: 602 - protein, 27 aa, Artificial
  synthetic human C35/NY-ESO-1 polytope
QLSLLMWITFEIEINGQLQLSLLMWIT

SEQ ID NO: 603 - protein, 38 aa, Artificial
  synthetic human C35/NY-ESO-1-MAGE-3 polytope
SLLMWITQCFLPVFFEIEINGQLTSYVKVLHHMVKISG

SEQ ID NO: 604 - protein, 18 aa, Artificial
  synthetic human C35/MAGE-1 polytope
IEINGQLVFEADPTGHSY

SEQ ID NO: 605 - protein, 27 aa, Artificial
  synthetic human C35/MAGE-1 polytope
EADPTGHSYIEINGQLVFEADPTGHSY

SEQ ID NO: 606 - protein, 18 aa, Artificial
  synthetic human C35/MAGE-1 polytope
IEINGQLVFSAYGEPRKL

SEQ ID NO: 607 - protein, 27 aa, Artificial
  synthetic human C35/MAGE-1 polytope
SAYGEPRKLIEINGQLVFSAYGEPRKL

SEQ ID NO: 608 - protein, 18 aa, Artificial
  synthetic human C35/MAGE-3 polytope
IEINGQLVFEVDPIGHLY

SEQ ID NO: 609 - protein, 27 aa, Artificial
  synthetic human C35/MAGE-3 polytope
EVDPIGHLYIEINGQLVFEVDPIGHLY

SEQ ID NO: 610 - protein, 18 aa, Artificial
  synthetic human C35/MAGE-3 polytope
IEINGQLVFFLWGPRALV

SEQ ID NO: 611 - protein, 27 aa, Artificial
  synthetic human C35/MAGE-3 polytope
FLWGPRALVIEINGQLVFFLWGPRALV

SEQ ID NO: 612 - protein, 19 aa, Artificial
  synthetic human C35/MAGE-3 polytope
IEINGQLVFMEVDPIGHLY

SEQ ID NO: 613 - protein, 29 aa, Artificial
  synthetic human C35/MAGE-3 polytope
MEVDPIGHLYIEINGQLVFMEVDPIGHLY

SEQ ID NO: 614 - protein, 18 aa, Artificial
  synthetic human C35/BAGE polytope
IEINGQLVFAARAVFLAL

SEQ ID NO: 615 - protein, 27 aa, Artificial
  synthetic human C35/BAGE polytope
AARAVFLALIEINGQLVFAARAVFLAL

SEQ ID NO: 616 - protein, 17 aa, Artificial
  synthetic human C35/GAGE-1,2 polytope
IEINGQLVFYRPRPRRY

SEQ ID NO: 617 - protein, 25 aa, Artificial
  synthetic human C35/GAGE-1,2 polytope
YRPRPRRYIEINGQLVFYRPRPRRY

SEQ ID NO: 618 - protein, 19 aa, Artificial
  synthetic human C35/RAGE polytope
IEINGQLVFSPSSNRIRNT

SEQ ID NO: 619 - protein, 29 aa, Artificial
  synthetic human C35/RAGE polytope
SPSSNRIRNTIEINGQLVFSPSSNRIRNT

SEQ ID NO: 620 - protein, 18 aa, Artificial
  synthetic human C35/CDK4 polytope
IEINGQLVFCDPHSGHFV

SEQ ID NO: 621 - protein, 29 aa, Artificial
  synthetic human C35/CDK4 polytope
ACDPHSGHFVIEINGQLVFACDPHSGHFV

SEQ ID NO: 622 - protein, 18 aa, Artificial
  synthetic human C35/beta-catenin polytope
IEINGQLVFSYLDSGIHF

SEQ ID NO: 623 - protein, 27 aa, Artificial
  synthetic human C35/beta-catenin polytope
SYLDSGIHFIEINGQLVFSYLDSGIHF

SEQ ID NO: 624 - protein, 18 aa, Artificial
  synthetic human C35/tyrosinase polytope
IEINGQLVFMLLAVLYCL

SEQ ID NO: 625 - protein, 27 aa, Artificial
  synthetic human C35/tyrosinase polytope
MLLAVLYCLIEINGQLVFMLLAVLYCL

SEQ ID NO: 626 - protein, 18 aa, Artificial
  synthetic human C35/tyrosinase polytope
IEINGQLVFAFLPWHRLF

SEQ ID NO: 627 - protein, 27 aa, Artificial
  synthetic human C35/tyrosinase polytope
AFLPWHRLFIEINGQLVFAFLPWHRLF

SEQ ID NO: 628 - protein, 24 aa, Artificial
  synthetic human C35/tyrosinase polytope
IEINGQLVFQNILLSNAPLGPQFP

SEQ ID NO: 629 - protein, 39 aa, Artificial
  synthetic human C35/tyrosinase polytope
QNILLSNAPLGPQFPIEINGQLVFQNILLSNAPLGPQFP

SEQ ID NO: 630 - protein, 24 aa, Artificial
  synthetic human C35/tyrosinase polytope
IEINGQLVFDYSYLQDSDPDSFQD

SEQ ID NO: 631 - protein, 39 aa, Artificial
  synthetic human C35/tyrosinase polytope
DYSYLQDSDPDSFQDIEINGQLVFDYSYLQDSDPDSFQD

SEQ ID NO: 632 - protein, 18 aa, Artificial
  synthetic human C35/Melan-A polytope
IEINGQLVFILTVILGVL

SEQ ID NO: 633 - protein, 27 aa, Artificial
  synthetic human C35/Melan-A polytope
ILTVILGVLIEINGQLVFILTVILGVL

SEQ ID NO: 634 - protein, 18 aa, Artificial
  synthetic human C35/gp100 polytope
IEINGQLVFKTWGQYWQV

SEQ ID NO: 635 - protein, 27 aa, Artificial
  synthetic human C35/gp100 polytope
KTWGQYWQVIEINGQLVFKTWGQYWQV

SEQ ID NO: 636 - protein, 18 aa, Artificial
  synthetic human C35/gp100 polytope
IEINGQLVFITDQVPFSV

SEQ ID NO: 637 - protein, 27 aa, Artificial
  synthetic human C35/gp100 polytope
ITDQVPFSVIEINGQLVFITDQVPFSV

SEQ ID NO: 638 - protein, 18 aa, Artificial
  synthetic human C35/gp100 polytope
IEINGQLVFYLEPGPVTA

SEQ ID NO: 639 - protein, 27 aa, Artificial
  synthetic human C35/gp100 polytope
YLEPGPVTAIEINGQLVFYLEPGPVTA

SEQ ID NO: 640 - protein, 19 aa, Artificial
  synthetic human C35/gp100 polytope
IEINGQLVFLLDGTATLRL

SEQ ID NO: 641 - protein, 29 aa, Artificial
  synthetic human C35/gp100 polytope
LLDGTATLRLIEINGQLVFLLDGTATLRL

SEQ ID NO: 642 - protein, 19 aa, Artificial
  synthetic human C35/gp100 polytope
IEINGQLVFVLYRYGSFSV

SEQ ID NO: 643 - protein, 29 aa, Artificial
  synthetic human C35/gp100 polytope
VLYRYGSFSVIEINGQLVFVLYRYGSFSV

SEQ ID NO: 644 - protein, 18 aa, Artificial
  synthetic human C35/PRAME polytope
IEINGQLVFLYVDSLFFL

SEQ ID NO: 645 - protein, 27 aa, Artificial
  synthetic human C35/PRAME polytope
LYVDSLFFLIEINGQLVFLYVDSLFFL

SEQ ID NO: 646 - protein, 21 aa, Artificial
  synthetic human C35/MAGE-6 polytope
IEINGQLVFKISGGPRISYPL

SEQ ID NO: 647 - protein, 33 aa, Artificial
  synthetic human C35/MAGE-6 polytope
KISGGPRISYPLIEINGQLVFKISGGPRISYPL

SEQ ID NO: 648 - protein, 20 aa, Artificial
  synthetic human C35/NY-ESO-1 polytope
IEINGQLVFSLLMWITQCFL

SEQ ID NO: 649 - protein, 31 aa, Artificial
  synthetic human C35/NY-ESO-1 polytope
SLLMWITQCFLIEINGQLVFSLLMWITQCFL

SEQ ID NO: 650 - protein, 18 aa, Artificial
  synthetic human C35/NY-ESO-1 polytope
IEINGQLVFSLLMWITQC

SEQ ID NO: 651 - protein, 27 aa, Artificial
  synthetic human C35/NY-ESO-1 polytope
SLLMWITQCIEINGQLVFSLLMWITQC

SEQ ID NO: 652 - protein, 18 aa, Artificial
  synthetic human C35/NY-ESO-1 polytope
IEINGQLVFQLSLLMWIT

SEQ ID NO: 653 - protein, 27 aa, Artificial
  synthetic human C35/NY-ESO-1 polytope
QLSLLMWITIEINGQLVFQLSLLMWIT

SEQ ID NO: 654 - protein, 38 aa, Artificial
  synthetic human C35/NY-ESO-1/MAGE-3 polytope
SLLMWITQCFLPVFIEINGQLVFTSYVKVLHHMVKISG

SEQ ID NO: 655 - protein, 18 aa, Artificial
  synthetic human C35/MAGE-1 polytope
KLENGGFPYEADPTGHSY

SEQ ID NO: 656 - protein, 27 aa, Artificial
  synthetic human C35/MAGE-1 polytope
EADPTGHSYKLENGGFPYEADPTGHSY

SEQ ID NO: 657 - protein, 18 aa, Artificial
  synthetic human C35/MAGE-1 polytope
KLENGGFPYSAYGEPRKL

SEQ ID NO: 658 - protein, 27 aa, Artificial
  synthetic human C35/MAGE-1 polytope
SAYGEPRKLKLENGGFPYSAYGEPRKL

SEQ ID NO: 659 - protein, 18 aa, Artificial
  synthetic human C35/MAGE-3 polytope
KLENGGFPYEVDPIGHLY

SEQ ID NO: 660 - protein, 27 aa, Artificial
  synthetic human C35/MAGE-3 polytope
EVDPIGHLYKLENGGFPYEVDPIGHLY

SEQ ID NO: 661 - protein, 18 aa, Artificial
  synthetic human C35/MAGE-3 polytope
KLENGGFPYFLWGPRALV

SEQ ID NO: 662 - protein, 27 aa, Artificial
  synthetic human C35/MAGE-3 polytope
FLWGPRALVKLENGGFPYFLWGPRALV

SEQ ID NO: 663 - protein, 19 aa, Artificial
  synthetic human C35/MAGE-3 polytope
KLENGGFPYMEVDPIGHLY

SEQ ID NO: 664 - protein, 29 aa, Artificial
  synthetic human C35/MAGE-3 polytope
MEVDPIGHLYKLENGGFPYMEVDPIGHLY

SEQ ID NO: 665 - protein, 18 aa, Artificial
  synthetic human C35/BAGE polytope
KLENGGFPYAARAVFLAL

SEQ ID NO: 666 - protein, 27 aa, Artificial
  synthetic human C35/BAGE polytope
AARAVFLALKLENGGFPYAARAVFLAL

SEQ ID NO: 667 - protein, 17 aa, Artificial
  synthetic human C35/GAGE-1,2 polytope
KLENGGFPYYRPRPRRY

SEQ ID NO: 668 - protein, 25 aa, Artificial
  synthetic human C35/GAGE-1,2 polytope
YRPRPRRYKLENGGFPYYRPRPRRY

SEQ ID NO: 669 - protein, 19 aa, Artificial
  synthetic human C35/RAGE polytope
KLENGGFPYSPSSNRIRNT

SEQ ID NO: 670 - protein, 29 aa, Artificial
  synthetic human C35/RAGE polytope
SPSSNRIRNTKLENGGFPYSPSSNRIRNT

SEQ ID NO: 671 - protein, 19 aa, Artificial
  synthetic human C35/CDK4 polytope
KLENGGFPYACDPHSGHFV

SEQ ID NO: 672 - protein, 29 aa, Artificial
  synthetic human C35/CDK4 polytope
ACDPHSGHFVKLENGGFPYACDPHSGHFV

SEQ ID NO: 673 - protein, 18 aa, Artificial
  synthetic human C35/beta-catenin polytope
KLENGGFPYSYLDSGIHF

SEQ ID NO: 674 - protein, 27 aa, Artificial
  synthetic human C35/beta-catenin polytope
SYLDSGIHFKLENGGFPYSYLDSGIHF

SEQ ID NO: 675 - protein, 18 aa, Artificial
  synthetic human C35/tyrosinase polytope
KLENGGFPYMLLAVLYCL

SEQ ID NO: 676 - protein, 27 aa, Artificial
  synthetic human C35/tyrosinase polytope
MLLAVLYCLKLENGGFPYMLLAVLYCL

SEQ ID NO: 677 - protein, 18 aa, Artificial
  synthetic human C35/tyrosinase polytope
KLENGGFPYAFLPWHRLF

SEQ ID NO: 678 - protein, 27 aa, Artificial
  synthetic human C35/tyrosinase polytope
AFLPWHRLFKLENGGFPYAFLPWHRLF

SEQ ID NO: 679 - protein, 24 aa, Artificial
  synthetic human C35/tyrosinase polytope
KLENGGFPYQNILLSNAPLGPQFP

SEQ ID NO: 680 - protein, 39 aa, Artificial
  synthetic human C35/tyrosinase polytope
QNILLSNAPLGPQFPKLENGGFPYQNILLSNAPLGPQFP

SEQ ID NO: 681 - protein, 24 aa, Artificial
  synthetic human C35/tyrosinase polytope
KLENGGFPYDYSYLQDSDPDSFQD

SEQ ID NO: 682 - protein, 39 aa, Artificial
  synthetic human C35/tyrosinase polytope
DYSYLQDSDPDSFQDKLENGGFPYDYSYLQDSDPDSFQD

SEQ ID NO: 683 - protein, 18 aa, Artificial
  synthetic human C35/Melan-A polytope
KLENGGFPYILTVILGVL

SEQ ID NO: 684 - protein, 27 aa, Artificial
  synthetic human C35/Melan-A polytope
ILTVILGVLKLENGGFPYILTVILGVL

SEQ ID NO: 685 - protein, 18 aa, Artificial
  synthetic human C35/gp100 polytope
KLENGGFPYKTWGQYWQV

SEQ ID NO: 686 - protein, 27 aa, Artificial
  synthetic human C35/gp100 polytope
KTWGQYWQVKLENGGFPYKTWGQYWQV

SEQ ID NO: 687 - protein, 18 aa, Artificial
  synthetic human C35/gp100 polytope
KLENGGFPYITDQVPFSV

SEQ ID NO: 688 - protein, 27 aa, Artificial
  synthetic human C35/gp100 polytope
ITDQVPFSVKLENGGFPYITDQVPFSV

SEQ ID NO: 689 - protein, 18 aa, Artificial
  synthetic human C35/gp100 polytope
KLENGGFPYYLEPGPVTA

SEQ ID NO: 690 - protein, 27 aa, Artificial
  synthetic human C35/gp100 polytope
YLEPGPVTAKLENGGFPYYLEPGPVTA

SEQ ID NO: 691 - protein, 19 aa, Artificial
  synthetic human C35/gp100 polytope
KLENGGFPYLLDGTATLRL

SEQ ID NO: 692 - protein, 29 aa, Artificial
  synthetic human C35/gp100 polytope
LLDGTATLRLKLENGGFPYLLDGTATLRL

SEQ ID NO: 693 - protein, 19 aa, Artificial
  synthetic human C35/gp100 polytope
KLENGGFPYVLYRYGSFSV

SEQ ID NO: 694 - protein, 29 aa, Artificial
  synthetic human C35/gp100 polytope
VLYRYGSFSVKLENGGFPYVLYRYGSFSV

SEQ ID NO: 695 - protein, 18 aa, Artificial
  synthetic human C35/PRAME polytope
KLENGGFPYLYVDSLFFL

SEQ ID NO: 696 - protein, 27 aa, Artificial
  synthetic human C35/PRAME polytope
LYVDSLFFLKLENGGFPYLYVDSLFFL

SEQ ID NO: 697 - protein, 21 aa, Artificial
  synthetic human C35/MAGE-6 polytope
KLENGGFPYKISGGPRISYPL

SEQ ID NO: 698 - protein, 33 aa, Artificial
  synthetic human C35/MAGE-6 polytope
KISGGPRISYPLKLENGGFPYKISGGPRISYPL

SEQ ID NO: 699 - protein, 20 aa, Artificial
  synthetic human C35/NY-ESO-1 polytope
KLENGGFPYSLLMWITQCFL

SEQ ID NO: 700 - protein, 31 aa, Artificial
  synthetic human C35/NY-ESO-1 polytope
SLLMWITQCFLKLENGGFPYSLLMWITQCFL

SEQ ID NO: 701 - protein, 18 aa, Artificial
  synthetic human C35/NY-ESO-1 polytope
KLENGGFPYSLLMWITQC

SEQ ID NO: 702 - protein, 27 aa, Artificial
  synthetic human C35/NY-ESO-1 polytope
SLLMWITQCKLENGGFPYSLLMWITQC

SEQ ID NO: 703 - protein, 18 aa, Artificial
  synthetic human C35/NY-ESO-1 polytope
KLENGGFPYQLSLLMWIT

SEQ ID NO: 704 - protein, 27 aa, Artificial
  synthetic human C35/NY-ESO-1 polytope
QLSLLMWITKLENGGFPYQLSLLMWIT

SEQ ID NO: 705 - protein, 38 aa, Artificial
  synthetic human C35/NY-ESO-1/MAGE-3 polytope
SLLMWITQCFLPVFKLENGGFPYTSYVKVLHHMVKISG

SEQ ID NO: 706 - protein, 24 aa, Artificial
  synthetic human C35/MAGE-1 polytope
QLVFSKLENGGFPYEEADPTGHSY

SEQ ID NO: 707 - protein, 33 aa, Artificial
  synthetic human C35/MAGE-1 polytope
EADPTGHSYQLVFSKLENGGFPYEEADPTGHSY

SEQ ID NO: 708 - protein, 24 aa, Artificial
  synthetic human C35/MAGE-1 polytope
QLVFSKLENGGFPYESAYGEPRKL

SEQ ID NO: 709 - protein, 33 aa, Artificial
  synthetic human C35/MAGE-1 polytope
SAYGEPRKLQLVFSKLENGGFPYESAYGEPRKL

SEQ ID NO: 710 - protein, 24 aa, Artificial
  synthetic human C35/MAGE-3 polytope
QLVFSKLENGGFPYEEVDPIGHLY

SEQ ID NO: 711 - protein, 33 aa, Artificial
  synthetic human C35/MAGE-3 polytope
EVDPIGHLYQLVFSKLENGGFPYEEVDPIGHLY

SEQ ID NO: 712 - protein, 24 aa, Artificial
  synthetic human C35/MAGE-3 polytope
QLVFSKLENGGFPYEFLWGPRALV

SEQ ID NO: 713 - protein, 33 aa, Artificial
  synthetic human C35/MAGE-3 polytope
FLWGPRALVQLVFSKLENGGFPYEFLWGPRALV

SEQ ID NO: 714 - protein, 25 aa, Artificial
  synthetic human C35/MAGE-3 polytope
QLVFSKLENGGFPYEMEVDPIGHLY

SEQ ID NO: 715 - protein, 35 aa, Artificial
  synthetic human C35/MAGE-3 polytope
MEVDPIGHLYQLVFSKLENGGFPYEMEVDPIGHLY

SEQ ID NO: 716 - protein, 24 aa, Artificial
  synthetic human C35/BAGE polytope
QLVFSKLENGGFPYEAARAVFLAL

SEQ ID NO: 717 - protein, 33 aa, Artificial
  synthetic human C35/BAGE polytope
AARAVFLALQLVFSKLENGGFPYEAARAVFLAL

SEQ ID NO: 718 - protein, 23 aa, Artificial
  synthetic human C35/GAGE-1,2 polytope
QLVFSKLENGGFPYEYRPRPRRY

SEQ ID NO: 719 - protein, 31 aa, Artificial
  synthetic human C35/GAGE-1,2 polytope
YRPRPRRYQLVFSKLENGGFPYEYRPRPRRY

SEQ ID NO: 720 - protein, 25 aa, Artificial
  synthetic human C35/RAGE polytope
QLVFSKLENGGFPYESPSSNRIRNT

SEQ ID NO: 721 - protein, 35 aa, Artificial
  synthetic human C35/RAGE polytope
SPSSNRIRNTQLVFSKLENGGFPYESPSSNRIRNT

SEQ ID NO: 722 - protein, 25 aa, Artificial
  synthetic human C35/CDK4 polytope
QLVFSKLENGGFPYEACDPHSGHFV

SEQ ID NO: 723 - protein, 35 aa, Artificial
  synthetic human C35/CDK4 polytope
ACDPHSGHFVQLVFSKLENGGFPYEACDPHSGHFV

SEQ ID NO: 724 - protein, 24 aa, Artificial
  synthetic human C35/beta-catenin polytope
QLVFSKLENGGFPYESYLDSGIHF

SEQ ID NO: 725 - protein, 33 aa, Artificial
  synthetic human C35/beta-catenin polytope
SYLDSGIHFQLVFSKLENGGFPYESYLDSGIHF

SEQ ID NO: 726 - protein, 24 aa, Artificial
  synthetic human C35/tyrosinase polytope
QLVFSKLENGGFPYEMLLAVLYCL

SEQ ID NO: 727 - protein, 33 aa, Artificial
  synthetic human C35/tyrosinase polytope
MLLAVLYCLQLVFSKLENGGFPYEMLLAVLYCL

SEQ ID NO: 728 - protein, 24 aa, Artificial
  synthetic human C35/tyrosinase polytope
QLVFSKLENGGFPYEAFLPWHRLF

SEQ ID NO: 729 - protein, 33 aa, Artificial
  synthetic human C35/tyrosinase polytope
AFLPWHRLFQLVFSKLENGGFPYEAFLPWHRLF

SEQ ID NO: 730 - protein, 30 aa, Artificial
  synthetic human C35/tyrosinase polytope
QLVFSKLENGGFPYEQNILLSNAPLGPQFP

SEQ ID NO: 731 - protein, 45 aa, Artificial
  synthetic human C35/tyrosinase polytope
QNILLSNAPLGPQFPQLVFSKLENGGFPYEQNILLSNAPLGPQFP

SEQ ID NO: 732 - protein, 30 aa, Artificial
  synthetic human C35/tyrosinase polytope
QLVFSKLENGGFPYEDYSYLQDSDPDSFQD

SEQ ID NO: 733 - protein, 45 aa, Artificial
  synthetic human C35/tyrosinase polytope
DYSYLQDSDPDSFQDQLVFSKLENGGFPYEDYSYLQDSDPDSFQD

SEQ ID NO: 734 - protein, 24 aa, Artificial
  synthetic human C35/Melan-A polytope
QLVFSKLENGGFPYEILTVILGVL

SEQ ID NO: 735 - protein, 33 aa, Artificial
  synthetic human C35/Melan-A polytope
ILTVILGVLQLVFSKLENGGFPYEILTVILGVL

SEQ ID NO: 736 - protein, 24 aa, Artificial
  synthetic human C35/gp100 polytope
QLVFSKLENGGFPYEKTWGQYWQV

SEQ ID NO: 737 - protein, 33 aa, Artificial
  synthetic human C35/gp100 polytope
KTWGQYWQVQLVFSKLENGGFPYEKTWGQYWQV

SEQ ID NO: 738 - protein, 24 aa, Artificial
  synthetic human C35/gp100 polytope
QLVFSKLENGGFPYEITDQVPFSV

SEQ ID NO: 739 - protein, 33 aa, Artificial
  synthetic human C35/gp100 polytope
ITDQVPFSVQLVFSKLENGGFPYEITDQVPFSV

SEQ ID NO: 740 - protein, 24 aa, Artificial
  synthetic human C35/gp100 polytope
QLVFSKLENGGFPYEYLEPGPVTA

SEQ ID NO: 741 - protein, 33 aa, Artificial
  synthetic human C35/gp100 polytope
YLEPGPVTAQLVFSKLENGGFPYEYLEPGPVTA

SEQ ID NO: 742 - protein, 25 aa, Artificial
  synthetic human C35/gp100 polytope
QLVFSKLENGGFPYELLDGTATLRL

SEQ ID NO: 743 - protein, 35 aa, Artificial
  synthetic human C35/gp100 polytope
LLDGTATLRLQLVFSKLENGGFPYELLDGTATLRL

SEQ ID NO: 744 - protein, 25 aa, Artificial
  synthetic human C35/gp100 polytope
QLVFSKLENGGFPYEVLYRYGSFSV

SEQ ID NO: 745 - protein, 35 aa, Artificial
  synthetic human C35/gp100 polytope
VLYRYGSFSVQLVFSKLENGGFPYEVLYRYGSFSV

SEQ ID NO: 746 - protein, 24 aa, Artificial
  synthetic human C35/PRAME polytope
QLVFSKLENGGFPYELYVDSLFFL

SEQ ID NO: 747 - protein, 33 aa, Artificial
  synthetic human C35/PRAME polytope
LYVDSLFFLQLVFSKLENGGFPYELYVDSLFFL

SEQ ID NO: 748 - protein, 27 aa, Artificial
  synthetic human C35/MAGE-6 polytope
QLVFSKLENGGFPYEKISGGPRISYPL

SEQ ID NO: 749 - protein, 39 aa, Artificial
  synthetic human C35/MAGE-6 polytope
KISGGPRISYPLQLVFSKLENGGFPYEKISGGPRISYPL

SEQ ID NO: 750 - protein, 26 aa, Artificial
  synthetic human C35/NY-ESO-1 polytope
QLVFSKLENGGFPYESLLMWITQCFL

SEQ ID NO: 751 - protein, 37 aa, Artificial
  synthetic human C35/NY-ESO-1 polytope
SLLMWITQCFLQLVFSKLENGGFPYESLLMWITQCFL

SEQ ID NO: 752 - protein, 24 aa, Artificial
  synthetic human C35/NY-ESO-1 polytope
QLVFSKLENGGFPYESLLMWITQC

SEQ ID NO: 753 - protein, 33 aa, Artificial
  synthetic human C35/NY-ESO-1 polytope
SLLMWITQCQLVFSKLENGGFPYESLLMWITQC

SEQ ID NO: 754 - protein, 24 aa, Artificial
  synthetic human C35/NY-ESO-1 polytope
QLVFSKLENGGFPYEQLSLLMWIT

SEQ ID NO: 755 - protein, 33 aa, Artificial
  synthetic human C35/NY-ESO-1 polytope
QLSLLMWITQLVFSKLENGGFPYEQLSLLMWIT

SEQ ID NO: 756 - protein, 44 aa, Artificial
  synthetic human C35/NY-ESO-1/MAGE-3 polytope
SLLMWITQCFLPVFQLVFSKLENGGFPYETSYVKVLHHMVKISG

SEQ ID NO: 757 - protein, 18 aa, Artificial
  synthetic human C35/MAGE-1 polytope
GGFPYEKDLEADPTGHSY

SEQ ID NO: 758 - protein, 27 aa, Artificial
  synthetic human C35/MAGE-1 polytope
EADPTGHSYGGFPYEKDLEADPTGHSY

SEQ ID NO: 759 - protein, 18 aa, Artificial
  synthetic human C35/MAGE-1 polytope
GGFPYEKDLSAYGEPRKL

SEQ ID NO: 760 - protein, 27 aa, Artificial
  synthetic human C35/MAGE-1 polytope
SAYGEPRKLGGFPYEKDLSAYGEPRKL

SEQ ID NO: 761 - protein, 18 aa, Artificial
  synthetic human C35/MAGE-3 polytope
GGFPYEKDLEVDPIGHLY

SEQ ID NO: 762 - protein, 27 aa, Artificial
  synthetic human C35/MAGE-3 polytope
EVDPIGHLYGGFPYEKDLEVDPIGHLY

SEQ ID NO: 763 - protein, 18 aa, Artificial
  synthetic human C35/MAGE-3 polytope
GGFPYEKDLFLWGPRALV

SEQ ID NO: 764 - protein, 27 aa, Artificial
  synthetic human C35/MAGE-3 polytope
FLWGPRALVGGFPYEKDLFLWGPRALV

SEQ ID NO: 765 - protein, 19 aa, Artificial
  synthetic human C35/MAGE-3 polytope
GGFPYEKDLMEVDPIGHLY

SEQ ID NO: 766 - protein, 29 aa, Artificial
  synthetic human C35/MAGE-3 polytope
MEVDPIGHLYGGFPYEKDLMEVDPIGHLY

SEQ ID NO: 767 - protein, 18 aa, Artificial
  synthetic human C35/BAGE polytope
GGFPYEKDLAARAVFLAL

SEQ ID NO: 768 - protein, 27 aa, Artificial
  synthetic human C35/BAGE polytope
AARAVFLALGGFPYEKDLAARAVFLAL

SEQ ID NO: 769 - protein, 17 aa, Artificial
  synthetic human C35/GAGE-1,2 polytope
GGFPYEKDLYRPRPRRY

SEQ ID NO: 770 - protein, 25 aa, Artificial
  synthetic human C35/GAGE-1,2 polytope
YRPRPRRYGGFPYEKDLYRPRPRRY

SEQ ID NO: 771 - protein, 19 aa, Artificial
  synthetic human C35/RAGE polytope
GGFPYEKDLSPSSNRIRNT

SEQ ID NO: 772 - protein, 29 aa, Artificial
  synthetic human C35/RAGE polytope
SPSSNRIRNTGGFPYEKDLSPSSNRIRNT

SEQ ID NO: 773 - protein, 19 aa, Artificial
  synthetic human C35/CDK4 polytope
GGFPYEKDLACDPHSGHFV

SEQ ID NO: 774 - protein, 29 aa, Artificial
  synthetic human C35/CK4 polytope
ACDPHSGHFVGGFPYEKDLACDPHSGHFV

SEQ ID NO: 775 - protein, 18 aa, Artificial
  synthetic human C35/beta-catenin polytope
GGFPYEKDLSYLDSGIHF

SEQ ID NO: 776 - protein, 27 aa, Artificial
  synthetic human C35/beta-catenin polytope
SYLDSGIHFGGFPYEKDLSYLDSGIHF

SEQ ID NO: 777 - protein, 18 aa, Artificial
  synthetic human C35/tyrosinase polytope
GGFPYEKDLMLLAVLYCL

SEQ ID NO: 778 - protein, 27 aa, Artificial
  synthetic human C35/tyrosinase polytope
MLLAVLYCLGGFPYEKDLMLLAVLYCL

SEQ ID NO: 779 - protein, 18 aa, Artificial
  synthetic human C35/tyrosinase polytope
GGFPYEKDLAFLPWHRLF

SEQ ID NO: 780 - protein, 27 aa, Artificial
  synthetic human C35/tyrosinase polytope
AFLPWHRLFGGFPYEKDLAFLPWHRLF

SEQ ID NO: 781 - protein, 24 aa, Artificial
  synthetic human C35/tyrosinase polytope
GGFPYEKDLQNILLSNAPLGPQFP

SEQ ID NO: 782 - protein, 39 aa, Artificial
  synthetic human C35/tyrosinase polytope
QNILLSNAPLGPQFPGGFPYEKDLQNILLSNAPLGPQFP

SEQ ID NO: 783 - protein, 24 aa, Artificial
  synthetic human C35/tyrosinase polytope
GGFPYEKDLDYSYLQDSDPDSFQD

SEQ ID NO: 784 - protein, 39 aa, Artificial
  synthetic human C35/tyrosinase polytope
DYSYLQDSDPDSFQDGGFPYEKDLDYSYLQDSDPDSFQD

SEQ ID NO: 785 - protein, 18 aa, Artificial
  synthetic human C35/Melan-A polytope
GGFPYEKDLILTVILGVL

SEQ ID NO: 786 - protein, 27 aa, Artificial
  synthetic human C35/Melan-A polytope
ILTVILGVLGGFPYEKDLILTVILGVL

SEQ ID NO: 787 - protein, 18 aa, Artificial
  synthetic human C35/gp100 polytope
GGFPYEKDLKTWGQYWQV

SEQ ID NO: 788 - protein, 27 aa, Artificial
  synthetic human C35/gp100 polytope
KTWGQYWQVGGFPYEKDLKTWGQYWQV

SEQ ID NO: 789 - protein, 18 aa, Artificial
  synthetic human C35/gp100 polytope
GGFPYEKDLITDQVPFSV

SEQ ID NO: 790 - protein, 27 aa, Artificial
  synthetic human C35/gp100 polytope
ITDQVPFSVGGFPYEKDLITDQVPFSV

SEQ ID NO: 791 - protein, 18 aa, Artificial
  synthetic human C35/gp100 polytope
GGFPYEKDLYLEPGPVTA

SEQ ID NO: 792 - protein, 27 aa, Artificial
  synthetic human C35/gp100 polytope
YLEPGPVTAGGFPYEKDLYLEPGPVTA

SEQ ID NO: 793 - protein, 19 aa, Artificial
  synthetic human C35/gp100 polytope
GGFPYEKDLLLDGTATLRL

SEQ ID NO: 794 - protein, 29 aa, Artificial
  synthetic human C35/gp100 polytope
LLDGTATLRLGGFPYEKDLLLDGTATLRL

SEQ ID NO: 795 - protein, 19 aa, Artificial
  synthetic human C35/gp100 polytope
GGFPYEKDLVLYRYGSFSV

SEQ ID NO: 796 - protein, 29 aa, Artificial
  synthetic human C35/gp100 polytope
VLYRYGSFSVGGFPYEKDLVLYRYGSFSV

SEQ ID NO: 797 - protein, 18 aa, Artificial
  synthetic human C35/PRAME polytope
GGFPYEKDLLYVDSLFFL

SEQ ID NO: 798 - protein, 27 aa, Artificial
  synthetic human C35/PRAME polytope
LYVDSLFFLGGFPYEKDLLYVDSLFFL

SEQ ID NO: 799 - protein, 21 aa, Artificial
  synthetic human C35/MAGE-6 polytope
GGFPYEKDLKISGGPRISYPL

SEQ ID NO: 800 - protein, 33 aa, Artificial
  synthetic human C35/MAGE-6 polytope
KISGGPRISYPLGGFPYEKDLKISGGPRISYPL

SEQ ID NO: 801 - protein, 20 aa, Artificial
  synthetic human C35/NY-ESO-1 polytope
GGFPYEKDLSLLMWITQCFL

SEQ ID NO: 802 - protein, 31 aa, Artificial
  synthetic human C35/NY-ESO-1 polytope
SLLMWITQCFLGGFPYEKDLSLLMWITQCFL

SEQ ID NO: 803 - protein, 18 aa, Artificial
  synthetic human C35/NY-ESO-1 polytope
GGFPYEKDLSLLMWITQC

SEQ ID NO: 804 - protein, 27 aa, Artificial
  synthetic human C35/NY-ESO-1 polytope
SLLMWITQCGGFPYEKDLSLLMWITQC

SEQ ID NO: 805 - protein, 18 aa, Artificial
  synthetic human C35/NY-ESO-1 polytope
GGFPYEKDLQLSLLMWIT

SEQ ID NO: 806 - protein, 27 aa, Artificial
  synthetic human C35/NY-ESO-1 polytope
QLSLLMWITGGFPYEKDLQLSLLMWIT

SEQ ID NO: 807 - protein, 38 aa, Artificial
  synthetic human C35/NY-ESO-1/MAGE-3 polytope
SLLMWITQCFLPVFGGFPYEKDLTSYVKVLHHMVKISG

SEQ ID NO: 808 - protein, 18 aa, Artificial
  synthetic human C35/MAGE-1 polytope
KITNSRPPCEADPTGHSY

SEQ ID NO: 809 - protein, 27 aa, Artificial
  synthetic human C35/MAGE-1 polytope
EADPTGHSYKITNSRPPCEADPTGHSY

SEQ ID NO: 810 - protein, 18 aa, Artificial
  synthetic human C35/MAGE-1 polytope
KITNSRPPCSAYGEPRKL

SEQ ID NO: 811 - protein, 27 aa, Artificial
  synthetic human C35/MAGE-1 polytope
SAYGEPRKLKITNSRPPCSAYGEPRKL

SEQ ID NO: 812 - protein, 18 aa, Artificial
  synthetic human C35/MAGE-3 polytope
KITNSRPPCEVDPIGHLY

SEQ ID NO: 813 - protein, 27 aa, Artificial
  synthetic human C35/MAGE-3 polytope
EVDPIGHLYKITNSRPPCEVDPIGHLY

SEQ ID NO: 814 - protein, 18 aa, Artificial
  synthetic human C35/MAGE-3 polytope
KITNSRPPCFLWGPRALV

SEQ ID NO: 815 - protein, 27 aa, Artificial
  synthetic human C35/MAGE-3 polytope
FLWGPRALVKITNSRPPCFLWGPRALV

SEQ ID NO: 816 - protein, 19 aa, Artificial
  synthetic human C35/MAGE-3 polytope
KITNSRPPCMEVDPIGHLY

SEQ ID NO: 817 - protein, 29 aa, Artificial
  synthetic human C35/MAGE-3 polytope
MEVDPIGHLYKITNSRPPCMEVDPIGHLY

SEQ ID NO: 818 - protein, 18 aa, Artificial
  synthetic human C35/BAGE polytope
KITNSRPPCAARAVFLAL

SEQ ID NO: 819 - protein, 27 aa, Artificial
  synthetic human C35/BAGE polytope
AARAVFLALKITNSRPPCAARAVFLAL

SEQ ID NO: 820 - protein, 17 aa, Artificial
  synthetic human C35/GAGE-1,2 polytope
KITNSRPPCYRPRPRRY

SEQ ID NO: 821 - protein, 25 aa, Artificial
  synthetic human C35/BAGE polytope
YRPRPRRYKITNSRPPCYRPRPRRY

SEQ ID NO: 822 - protein, 19 aa, Artificial
  synthetic human C35/RAGE polytope
KITNSRPPCSPSSNRIRNT

SEQ ID NO: 823 - protein, 29 aa, Artificial
  synthetic human C35/RAGE polytope
SPSSNRIRNTKITNSRPPCSPSSNRIRNT

SEQ ID NO: 824 - protein, 19 aa, Artificial
  synthetic human C35/CDK4 polytope
KITNSRPPCACDPHSGHFV

SEQ ID NO: 825 - protein, 29 aa, Artificial
  synthetic human C35/CDK4 polytope
ACDPHSGHFVKITNSRPPCACDPHSGHFV

SEQ ID NO: 826 - protein, 18 aa, Artificial
  synthetic human C35/beta-catenin polytope
KITNSRPPCSYLDSGIHF

SEQ ID NO: 827 - protein, 27 aa, Artificial
  synthetic C35/beta-catenin polytope
SYLDSGIHFKITNSRPPCSYLDSGIHF

SEQ ID NO: 828 - protein, 18 aa, Artificial
  synthetic human C35/tyrosinase polytope
KITNSRPPCMLLAVLYCL

SEQ ID NO: 829 - protein, 27 aa, Artificial
  synthetic human C35/tyrosinase polytope
MLLAVLYCLKITNSRPPCMLLAVLYCL

SEQ ID NO: 830 - protein, 18 aa, Artificial
  synthetic human C35/tyrosinase polytope
KITNSRPPCAFLPWHRLF

SEQ ID NO: 831 - protein, 27 aa, Artificial
  synthetic human C35/tyrosinase polytope
AFLPWHRLFKITNSRPPCAFLPWHRLF

SEQ ID NO: 832 - protein, 24 aa, Artificial
  synthetic human C35/tyrosinase polytope
KITNSRPPCQNILLSNAPLGPQFP

SEQ ID NO: 833 - protein, 39 aa, Artificial
  synthetic human C35/tyrosinase polytope
QNILLSNAPLGPQFPKITNSRPPCQNILLSNAPLGPQFP

SEQ ID NO: 834 - protein, 24 aa, Artificial
  synthetic human C35/tyrosinase polytope
KITNSRPPCDYSYLQDSDPDSFQD

SEQ ID NO: 835 - protein, 39 aa, Artificial
  synthetic human C35/tyrosinase polytope
DYSYLQDSDPDSFQDKITNSRPPCDYSYLQDSDPDSFQD

SEQ ID NO: 836 - protein, 18 aa, Artificial
  synthetic human C25/Melan-A polytope
KITNSRPPCILTVILGVL

SEQ ID NO: 837 - protein, 26 aa, Artificial
  synthetic human C35/Melan-A polytope
ILTVILGVLKITNSRPPCILTVILGV

SEQ ID NO: 838 - protein, 18 aa, Artificial
  synthetic human C35/gp100 polytope
KITNSRPPCKTWGQYWQV

SEQ ID NO: 839 - protein, 27 aa, Artificial
  synthetic human C35/gp100 polytope
KTWGQYWQVKITNSRPPCKTWGQYWQV

SEQ ID NO: 840 - protein, 18 aa, Artificial
  synthetic human C35/gp100 polytope
KITNSRPPCITDQVPFSV

SEQ ID NO: 841 - protein, 27 aa, Artificial
  synthetic human C35/gp100 polytope
ITDQVPFSVKITNSRPPCITDQVPFSV

SEQ ID NO: 842 - protein, 18 aa, Artificial
  synthetic human C35/gp100 polytope
KITNSRPPCYLEPGPVTA

SEQ ID NO: 843 - protein, 27 aa, Artificial
  synthetic human C35/gp100 polytope
YLEPGPVTAKITNSRPPCYLEPGPVTA

SEQ ID NO: 844 - protein, 19 aa, Artificial
  synthetic human C35/gp100 polytope
KITNSRPPCLLDGTATLRL

SEQ ID NO: 845 - protein, 29 aa, Artificial
  synthetic human C35/gp100 polytope
LLDGTATLRLKITNSRPPCLLDGTATLRL

SEQ ID NO: 846 - protein, 19 aa, Artificial
  synthetic human C35/gp100 polytope
KITNSRPPCVLYRYGSFSV

SEQ ID NO: 847 - protein, 29 aa, Artificial
  synthetic human C35/gp100 polytope
VLYRYGSFSVKITNSRPPCVLYRYGSFSV

SEQ ID NO: 848 - protein, 18 aa, Artificial
  synthetic human C35/PRAME polytope
KITNSRPPCLYVDSLFFL

SEQ ID NO: 849 - protein, 27 aa, Artificial
  synthetic human C35/PRAME polytope
LYVDSLFFLKITNSRPPCLYVDSLFFL

SEQ ID NO: 850 - protein, 21 aa, Artificial
  synthetic human C35/MAGE-6 polytope
KITNSRPPCKISGGPRISYPL

SEQ ID NO: 851 - protein, 33 aa, Artificial
  synthetic human C35/MAGE-6 polytope
KISGGPRISYPLKITNSRPPCKISGGPRISYPL

SEQ ID NO: 852 - protein, 20 aa, Artificial
  synthetic human C35/NY-ESO-1 polytope
KITNSRPPCSLLMWITQCFL

SEQ ID NO: 853 - protein, 31 aa, Artificial
  synthetic human C35/NY-ESO-1 polytope
SLLMWITQCFLKITNSRPPCSLLMWITQCFL

SEQ ID NO: 854 - protein, 18 aa, Artificial
  synthetic human C35/NY-ESO-1 polytope
KITNSRPPCSLLMWITQC

SEQ ID NO: 855 - protein, 27 aa, Artificial
  synthetic human C35/NY-ESO-1 polytope
SLLMWITQCKITNSRPPCSLLMWITQC

SEQ ID NO: 856 - protein, 18 aa, Artificial
  synthetic human C35/NY-ESO-1 polytope
KITNSRPPCQLSLLMWIT

SEQ ID NO: 857 - protein, 27 aa, Artificial
  synthetic human C35/NY-ESO-1 polytope
QLSLLMWITKITNSRPPCQLSLLMWIT

SEQ ID NO: 858 - protein, 38 aa, Artificial
  synthetic human C35/NY-ESO-1/MAGE-3 polytope
SLLMWITQCFLPVFKITNSRPPCTSYVKVLHHMVKISG

SEQ ID NO: 859 - protein, 19 aa, Artificial
  synthetic human C35/MAGE-1 polytope
KITNSRPPCVEADPTGHSY

SEQ ID NO: 860 - protein, 28 aa, Artificial
  synthetic human C35/MAGE-1 polytope
EADPTGHSYKITNSRPPCVEADPTGHSY

SEQ ID NO: 861 - protein, 19 aa, Artificial
  synthetic human C35/MAGE-1 polytope
KITNSRPPCVSAYGEPRKL

SEQ ID NO: 862 - protein, 28 aa, Artificial
  synthetic human C35/MAGE-1 polytope
SAYGEPRKLKITNSRPPCVSAYGEPRKL

SEQ ID NO: 863 - protein, 19 aa, Artificial
  synthetic human C35/MAGE-3 polytope
KITNSRPPCVEVDPIGHLY

SEQ ID NO: 864 - protein, 28 aa, Artificial
  synthetic human C35/MAGE-3 polytope
EVDPIGHLYKITNSRPPCVEVDPIGHLY

SEQ ID NO: 865 - protein, 19 aa, Artificial
  synthetic human C35/MAGE-3 polytope
KITNSRPPCVFLWGPRALV

SEQ ID NO: 866 - protein, 28 aa, Artificial
  synthetic human C35/MAGE-3 polytope
FLWGPRALVKITNSRPPCVFLWGPRALV

SEQ ID NO: 867 - protein, 20 aa, Artificial
  synthetic human C35/MAGE-3 polytope
KITNSRPPCVMEVDPIGHLY

SEQ ID NO: 868 - protein, 30 aa, Artificial
  synthetic human C35/MAGE-3 polytope
MEVDPIGHLYKITNSRPPCVMEVDPIGHLY

SEQ ID NO: 869 - protein, 19 aa, Artificial
  synthetic human C35/BAGE polytope
KITNSRPPCVAARAVFLAL

SEQ ID NO: 870 - protein, 28 aa, Artificial
  synthetic human C35/BAGE polytope
AARAVFLALKITNSRPPCVAARAVFLAL

SEQ ID NO: 871 - protein, 18 aa, Artificial
  synthetic human C35/GAGE-1,2 polytope
KITNSRPPCVYRPRPRRY

SEQ ID NO: 872 - protein, 26 aa, Artificial
  synthetic human C35/GAGE-1,2 polytope
YRPRPRRYKITNSRPPCVYRPRPRRY

SEQ ID NO: 873 - protein, 20 aa, Artificial
  synthetic human C35/RAGE polytope
KITNSRPPCVSPSSNRIRNT

SEQ ID NO: 874 - protein, 30 aa, Artificial
  synthetic human C35/RAGE polytope
SPSSNRIRNTKITNSRPPCVSPSSNRIRNT

SEQ ID NO: 875 - protein, 20 aa, Artificial
  synthetic human C35/CDK4 polytope
KITNSRPPCVACDPHSGHFV

SEQ ID NO: 876 - protein, 30 aa, Artificial
  synthetic human C35/CDK4 polytope
ACDPHSGHFVKITNSRPPCVACDPHSGHFV

SEQ ID NO: 877 - protein, 19 aa, Artificial
  synthetic human C35/beta-catenin polytope
KITNSRPPCVSYLDSGIHF

SEQ ID NO: 878 - protein, 28 aa, Artificial
  synthetic human C35/beta-catenin polytope
SYLDSGIHFKITNSRPPCVSYLDSGIHF

SEQ ID NO: 879 - protein, 19 aa, Artificial
  synthetic human C35/tyrosinase polytope
KITNSRPPCVMLLAVLYCL

SEQ ID NO: 880 - protein, 28 aa, Artificial
  synthetic human C35/tyrosinase polytope
MLLAVLYCLKITNSRPPCVMLLAVLYCL

SEQ ID NO: 881 - protein, 19 aa, Artificial
  synthetic human C35/tyrosinase polytope
KITNSRPPCVAFLPWHRLF

SEQ ID NO: 882 - protein, 28 aa, Artificial
  synthetic human C35/tyrosinase polytope
AFLPWHRLFKITNSRPPCVAFLPWHRLF

SEQ ID NO: 883 - protein, 25 aa, Artificial
  synthetic human C35/tyrosinase polytope
KITNSRPPCVQNILLSNAPLGPQFP

SEQ ID NO: 884 - protein, 40 aa, Artificial
  synthetic human C35/tyrosinase polytope
QNILLSNAPLGPQFPKITNSRPPCVQNILLSNAPLGPQFP

SEQ ID NO: 885 - protein, 25 aa, Artificial
  synthetic human C35/tyrosinase polytope
KITNSRPPCVDYSYLQDSDPDSFQD

SEQ ID NO: 886 - protein, 40 aa, Artificial
  synthetic human C35/tyrosinase polytope
DYSYLQDSDPDSFQDKITNSRPPCVDYSYLQDSDPDSFQD

SEQ ID NO: 887 - protein, 19 aa, Artificial
  synthetic human C35/Melan-A polytope
KITNSRPPCVILTVILGVL

SEQ ID NO: 888 - protein, 28 aa, Artificial
  synthetic human C35/Melan-A polytope
ILTVILGVLKITNSRPPCVILTVILGVL

SEQ ID NO: 889 - protein, 19 aa, Artificial
  synthetic human C35/gp100 polytope
KITNSRPPCVKTWGQYWQV

SEQ ID NO: 890 - protein, 28 aa, Artificial
  synthetic human C35/gp100 polytope
KTWGQYWQVKITNSRPPCVKTWGQYWQV

SEQ ID NO: 891 - protein, 19 aa, Artificial
  synthetic human C35/gp100 polytope
KITNSRPPCVITDQVPFSV

SEQ ID NO: 892 - protein, 28 aa, Artificial
  synthetic human C35/gp100 polytope
ITDQVPFSVKITNSRPPCVITDQVPFSV

SEQ ID NO: 893 - protein, 19 aa, Artificial
  synthetic human C35/gp100 polytope
KITNSRPPCVYLEPGPVTA

SEQ ID NO: 894 - protein, 28 aa, Artificial
  synthetic human C35/gp100 polytope
YLEPGPVTAKITNSRPPCVYLEPGPVTA

SEQ ID NO: 895 - protein, 20 aa, Artificial
  synthetic human C35/gp100 polytope
KITNSRPPCVLLDGTATLRL

SEQ ID NO: 896 - protein, 30 aa, Artificial
  synthetic human C35/gp100 polytope
LLDGTATLRLKITNSRPPCVLLDGTATLRL

SEQ ID NO: 897 - protein, 20 aa, Artificial
  synthetic human C35/gp100 polytope
KITNSRPPCVVLYRYGSFSV

SEQ ID NO: 898 - protein, 30 aa, Artificial
  synthetic human C35/gp100 polytope
VLYRYGSFSVKITNSRPPCVVLYRYGSFSV

SEQ ID NO: 899 - protein, 19 aa, Artificial
  synthetic human C35/PRAME polytope
KITNSRPPCVLYVDSLFFL

SEQ ID NO: 900 - protein, 28 aa, Artificial
  synthetic human C35/PRAME polytope
LYVDSLFFLKITNSRPPCVLYVDSLFFL

SEQ ID NO: 901 - protein, 22 aa, Artificial
  synthetic human C35/MAGE-6 polytope
KITNSRPPCVKISGGPRISYPL

SEQ ID NO: 902 - protein, 34 aa, Artificial
  synthetic human C35/MAGE-6 polytope
KISGGPRISYPLKITNSRPPCVKISGGPRISYPL

SEQ ID NO: 903 - protein, 21 aa, Artificial
  synthetic human C35/NY-ESO-1 polytope
KITNSRPPCVSLLMWITQCFL

SEQ ID NO: 904 - protein, 32 aa, Artificial
  synthetic human C35/NY-ESO-1 polytope
SLLMWITQCFLKITNSRPPCVSLLMWITQCFL

SEQ ID NO: 905 - protein, 19 aa, Artificial
  synthetic human C35/NY-ESO-1 polytope
KITNSRPPCVSLLMWITQC

SEQ ID NO: 906 - protein, 28 aa, Artificial
  synthetic human C35/NY-ESO-1 polytope
SLLMWITQCKITNSRPPCVSLLMWITQC

SEQ ID NO: 907 - protein, 19 aa, Artificial
  synthetic human C35/NY-ESO-1 polytope
KITNSRPPCVQLSLLMWIT

SEQ ID NO: 908 - protein, 28 aa, Artificial
  synthetic human C35/NY-ESO-1 polytope
QLSLLMWITKITNSRPPCVQLSLLMWIT

SEQ ID NO: 909 - protein, 39 aa, Artificial
  synthetic human C35/NY-ESO-1/MAGE-3 polytope
SLLMWITQCFLPVFKITNSRPPCVTSYVKVLHHMVKISG

SEQ ID NO: 910 - protein, 18 aa, Artificial
  synthetic human C35/MAGE-1 polytope
ITNSRPPCVEADPTGHSY

SEQ ID NO: 911 - protein, 27 aa, Artificial
  synthetic human C35/MAGE-1 polytope
EADPTGHSYITNSRPPCVEADPTGHSY

SEQ ID NO: 912 - protein, 18 aa, Artificial
  synthetic human C35/MAGE-1 polytope
ITNSRPPCVSAYGEPRKL

SEQ ID NO: 913 - protein, 27 aa, Artificial
  synthetic human C35/MAGE-1 polytope
SAYGEPRKLITNSRPPCVSAYGEPRKL

SEQ ID NO: 914 - protein, 18 aa, Artificial
  synthetic human C35/MAGE-3 polytope
ITNSRPPCVEVDPIGHLY

SEQ ID NO: 915 - protein, 27 aa, Artificial
  synthetic human C35/MAGE-3 polytope
EVDPIGHLYITNSRPPCVEVDPIGHLY

SEQ ID NO: 916 - protein, 18 aa, Artificial
  synthetic human C35/MAGE-3 polytope
ITNSRPPCVFLWGPRALV

SEQ ID NO: 917 - protein, 27 aa, Artificial
  synthetic human C35/MAGE-3 polytope
FLWGPRALVITNSRPPCVFLWGPRALV

SEQ ID NO: 918 - protein, 19 aa, Artificial
  synthetic human C35/MAGE-3 polytope
ITNSRPPCVMEVDPIGHLY

SEQ ID NO: 919 - protein, 29 aa, Artificial
  synthetic human C35/MAGE-3 polytope
MEVDPIGHLYITNSRPPCVMEVDPIGHLY

SEQ ID NO: 920 - protein, 18 aa, Artificial
  synthetic human C35/BAGE polytope
ITNSRPPCVAARAVFLAL

SEQ ID NO: 921 - protein, 27 aa, Artificial
  synthetic human C35/BAGE polytope
AARAVFLALITNSRPPCVAARAVFLAL

SEQ ID NO: 922 - protein, 17 aa, Artificial
  synthetic human C35/GAGE-1,2 polytope
ITNSRPPCVYRPRPRRY

SEQ ID NO: 923 - protein, 25 aa, Artificial
  synthetic human C35/GAGE-1,2 polytope
YRPRPRRYITNSRPPCVYRPRPRRY

SEQ ID NO: 924 - protein, 19 aa, Artificial
  synthetic human C35/RAGE polytope
ITNSRPPCVSPSSNRIRNT

SEQ ID NO: 925 - protein, 29 aa, Artificial
  synthetic human C35/RAGE polytope
SPSSNRIRNTITNSRPPCVSPSSNRIRNT

SEQ ID NO: 926 - protein, 19 aa, Artificial
  synthetic human C35/CDK4 polytope
ITNSRPPCVACDPHSGHFV

SEQ ID NO: 927 - protein, 29 aa, Artificial
  synthetic human C35/CDK4 polytope
ACDPHSGHFVITNSRPPCVACDPHSGHFV

SEQ ID NO: 928 - protein, 18 aa, Artificial
  synthetic human C35/beta-catenin polytope
ITNSRPPCVSYLDSGIHF

SEQ ID NO: 929 - protein, 27 aa, Artificial
  synthetic human C35/beta-catenin polytope
SYLDSGIHFITNSRPPCVSYLDSGIHF

SEQ ID NO: 930 - protein, 18 aa, Artificial
  synthetic human C35/tyrosinase polytope
ITNSRPPCVMLLAVLYCL

SEQ ID NO: 931 - protein, 27 aa, Artificial
  synthetic human C35/tyrosinase polytope
MLLAVLYCLITNSRPPCVMLLAVLYCL

SEQ ID NO: 932 - protein, 18 aa, Artificial
  synthetic human C35/tyrosinase polytope
ITNSRPPCVAFLPWHRLF

SEQ ID NO: 933 - protein, 27 aa, Artificial
  synthetic human C35/tyrosinase polytope
AFLPWHRLFITNSRPPCVAFLPWHRLF

SEQ ID NO: 934 - protein, 24 aa, Artificial
  synthetic human C35/tyrosinase polytope
ITNSRPPCVQNILLSNAPLGPQFP

SEQ ID NO: 935 - protein, 39 aa, Artificial
  synthetic human C35/tyrosinase polytope
QNILLSNAPLGPQFPITNSRPPCVQNILLSNAPLGPQFP

SEQ ID NO: 936 - protein, 24 aa, Artificial
  synthetic human C35/tyrosinase polytope
ITNSRPPCVDYSYLQDSDPDSFQD

SEQ ID NO: 937 - protein, 38 aa, Artificial
  synthetic human C35/tyrosinase polytope
DYSYLQDSDPDSFQDITNSRPPCVDSYLQDSDPDSFQD

SEQ ID NO: 938 - protein, 18 aa, Artificial
  synthetic human C35/Melan-A polytope
ITNSRPPCVILTVILGVL

SEQ ID NO: 939 - protein, 27 aa, Artificial
  synthetic human C35/Melan-A polytope
ILTVILGVLITNSRPPCVILTVILGVL

SEQ ID NO: 940 - protein, 18 aa, Artificial
  synthetic human C35/gp100 polytope
ITNSRPPCVKTWGQYWQV

SEQ ID NO: 941 - protein, 27 aa, Artificial
  synthetic human C35/gp100 polytope
KTWGQYWQVITNSRPPCVKTWGQYWQV

SEQ ID NO: 942 - protein, 18 aa, Artificial
  synthetic human C35/gp100 polytope
ITNSRPPCVITDQVPFSV

SEQ ID NO: 943 - protein, 27 aa, Artificial
  synthetic human C35/gp100 polytope
ITDQVPFSVITNSRPPCVITDQVPFSV

SEQ ID NO: 944 - protein, 18 aa, Artificial
  synthetic human C35/gp100 polytope
ITNSRPPCVYLEPGPVTA

SEQ ID NO: 945 - protein, 27 aa, Artificial
  synthetic human C35/gp100 polytope
YLEPGPVTAITNSRPPCVYLEPGPVTA

SEQ ID NO: 946 - protein, 19 aa, Artificial
  synthetic human C35/gp100 polytope
ITNSRPPCVLLDGTATLRL

SEQ ID NO: 947 - protein, 29 aa, Artificial
  synthetic human C35/gp100 polytope
LLDGTATLRLITNSRPPCVLLDGTATLRL

SEQ ID NO: 948 - protein, 19 aa, Artificial
  synthetic human C35/gp100 polytope
ITNSRPPCVVLYRYGSFSV

SEQ ID NO: 949 - protein, 29 aa, Artificial
  synthetic human C35/gp100 polytope
VLYRYGSFSVITNSRPPCVVLYRYGSFSV

SEQ ID NO: 950 - protein, 18 aa, Artificial
  synthetic human C35/PRAME polytope
ITNSRPPCVLYVDSLFFL

SEQ ID NO: 951 - protein, 27 aa, Artificial
  synthetic human C35/PRAME polytope
LYVDSLFFLITNSRPPCVLYVDSLFFL

SEQ ID NO: 952 - protein, 21 aa, Artificial
  synthetic human C35/MAGE-6 polytope
ITNSRPPCVKISGGPRISYPL

SEQ ID NO: 953 - protein, 33 aa, Artificial
  synthetic human C35/MAGE-6 polytope
KISGGPRISYPLITNSRPPCVKISGGPRISYPL

SEQ ID NO: 954 - protein, 20 aa, Artificial
  synthetic human C35/NY-ESO-1 polytope
ITNSRPPCVSLLMWITQCFL

SEQ ID NO: 955 - protein, 31 aa, Artificial
  synthetic human C35/NY-ESO-1 polytope
SLLMWITQCFLITNSRPPCVSLLMWITQCFL

SEQ ID NO: 956 - protein, 18 aa, Artificial
  synthetic human C35/NY-ESO-1 polytope
ITNSRPPCVSLLMWITQC

SEQ ID NO: 957 - protein, 27 aa, Artificial
  synthetic human C35/NY-ESO-1 polytope
SLLMWITQCITNSRPPCVSLLMWITQC

SEQ ID NO: 958 - protein, 18 aa, Artificial
  synthetic human C35/NY-ESO-1 polytope
ITNSRPPCVQLSLLMWIT

SEQ ID NO: 959 - protein, 27 aa, Artificial
  synthetic human C35/NY-ESO-1 polytope
QLSLLMWITITNSRPPCVQLSLLMWIT

SEQ ID NO: 960 - protein, 38 aa, Artificial
  synthetic human C35/NY-ESO-1/MAGE-3 polytope
SLLMWITQCFLPVFITNSRPPCVTSYVKVLHHMVKISG

SEQ ID NO: 961 - protein, 22 aa, Artificial
  synthetic human C35/MAGE-1 polytope
TLEKITNSRPPCVEADPTGHSY

SEQ ID NO: 962 - protein, 31 aa, Artificial
  synthetic human C35/MAGE-1 polytope
EADPTGHSYTLEKITNSRPPCVEADPTGHSY

SEQ ID NO: 963 - protein, 22 aa, Artificial
  synthetic human C35/MAGE-1 polytope
TLEKITNSRPPCVSAYGEPRKL

SEQ ID NO: 964 - protein, 31 aa, Artificial
  synthetic human C35/MAGE-1 polytope
SAYGEPRKLTLEKITNSRPPCVSAYGEPRKL

SEQ ID NO: 965 - protein, 22 aa, Artificial
  synthetic human C35/MAGE-3 polytope
TLEKITNSRPPCVEVDPIGHLY

SEQ ID NO: 966 - protein, 31 aa, Artificial
  synthetic human C35/MAGE-3 polytope
EVDPIGHLYTLEKITNSRPPCVEVDPIGHLY

SEQ ID NO: 967 - protein, 22 aa, Artificial
  synthetic human C35/MAGE-3 polytope
TLEKITNSRPPCVFLWGPRALV

SEQ ID NO: 968 - protein, 31 aa, Artificial
  synthetic human C35/MAGE-3 polytope
FLWGPRALVTLEKITNSRPPCVFLWGPRALV

SEQ ID NO: 969 - protein, 23 aa, Artificial
  synthetic human C35/MAGE-3 polytope
TLEKITNSRPPCVMEVDPIGHLY

SEQ ID NO: 970 - protein, 33 aa, Artificial
  synthetic human C35/MAGE-3 polytope
MEVDPIGHLYTLEKITNSRPPCVMEVDPIGHLY

SEQ ID NO: 971 - protein, 22 aa, Artificial
  synthetic human C35/BAGE polytope
TLEKITNSRPPCVAARAVFLAL

SEQ ID NO: 972 - protein, 31 aa, Artificial
  synthetic human C35/BAGE polytope
AARAVFLALTLEKITNSRPPCVAARAVFLAL

SEQ ID NO: 973 - protein, 21 aa, Artificial
  synthetic human C35/GAGE-1,2 polytope
TLEKITNSRPPCVYRPRPRRY

SEQ ID NO: 974 - protein, 29 aa, Artificial
  synthetic human C35/GAGE-1,2 polytope
YRPRPRRYTLEKITNSRPPCVYRPRPRRY

SEQ ID NO: 975 - protein, 23 aa, Artificial
  synthetic human C35/RAGE polytope
TLEKITNSRPPCVSPSSNRIRNT

SEQ ID NO: 976 - protein, 33 aa, Artificial
  synthetic human C35/RAGE polytope
SPSSNRIRNTTLEKITNSRPPCVSPSSNRIRNT

SEQ ID NO: 977 - protein, 23 aa, Artificial
  synthetic human C35/CDK4 polytope
TLEKITNSRPPCVACDPHSGHFV

SEQ ID NO: 978 - protein, 33 aa, Artificial
  synthetic human C35/CDK4 polytope
ACDPHSGHFVTLEKITNSRPPCVACDPHSGHFV

SEQ ID NO: 979 - protein, 22 aa, Artificial
  synthetic human C35/beta-catenin polytope
TLEKITNSRPPCVSYLDSGIHF

SEQ ID NO: 980 - protein, 31 aa, Artificial
  synthetic human C35/beta-catenin polytope
SYLDSGIHFTLEKITNSRPPCVSYLDSGIHF

SEQ ID NO: 981 - protein, 22 aa, Artificial
  synthetic human C35/tyrosinase polytope
TLEKITNSRPPCVMLLAVLYCL

SEQ ID NO: 982 - protein, 31 aa, Artificial
  synthetic human C35/tyrosinase polytope
MLLAVLYCLTLEKITNSRPPCVMLLAVLYCL

SEQ ID NO: 983 - protein, 22 aa, Artificial
  synthetic human C35/tyrosinase polytope
TLEKITNSRPPCVAFLPWHRLF

SEQ ID NO: 984 - protein, 31 aa, Artificial
  synthetic human C35/tyrosinase polytope
AFLPWHRLFTLEKITNSRPPCVAFLPWHRLF

SEQ ID NO: 985 - protein, 28 aa, Artificial
  synthetic human C35/tyrosinase polytope
TLEKITNSRPPCVQNILLSNAPLGPQFP

SEQ ID NO: 986 - protein, 43 aa, Artificial
  synthetic human C35/tyrosinase polytope
QNILLSNAPLGPQFPTLEKITNSRPPCVQNILLSNAPLGPQFP

SEQ ID NO: 987 - protein, 28 aa, Artificial
  synthetic human C35/tyrosinase polytope
TLEKITNSRPPCVDYSYLQDSDPDSFQD

SEQ ID NO: 988 - protein, 43 aa, Artificial
  synthetic human C35/tyrosinase polytope
DYSYLQDSDPDSFQDTLEKITNSRPPCVDYSYLQDSDPDSFQD

SEQ ID NO: 989 - protein, 22 aa, Artificial
  synthetic human C35/Melan-A polytope
TLEKITNSRPPCVILTVILGVL

SEQ ID NO: 990 - protein, 31 aa, Artificial
  synthetic human C35/Melan-A polytope
ILTVILGVLTLEKITNSRPPCVILTVILGVL

SEQ ID NO: 991 - protein, 22 aa, Artificial
  synthetic human C35/gp100 polytope
TLEKITNSRPPCVKTWGQYWQV

SEQ ID NO: 992 - protein, 31 aa, Artificial
  synthetic human C35/gp100 polytope
KTWGQYWQVTLEKITNSRPPCVKTWGQYWQV

SEQ ID NO: 993 - protein, 22 aa, Artificial
  synthetic human C35/gp100 polytope
TLEKITNSRPPCVITDQVPFSV

SEQ ID NO: 994 - protein, 31 aa, Artificial
  synthetic human C35/gp100 polytope
ITDQVPFSVTLEKITNSRPPCVITDQVPFSV

SEQ ID NO: 995 - protein, 22 aa, Artificial
  synthetic human C35/gp100 polytope
TLEKITNSRPPCVYLEPGPVTA

SEQ ID NO: 996 - protein, 31 aa, Artificial
  synthetic human C35/gp100 polytope
YLEPGPVTATLEKITNSRPPCVYLEPGPVTA

SEQ ID NO: 997 - protein, 23 aa, Artificial
  synthetic human C35/gp100 polytope
TLEKITNSRPPCVLLDGTATLRL

SEQ ID NO: 998 - protein, 33 aa, Artificial
  synthetic human C35/gp100 polytope
LLDGTATLRLTLEKITNSRPPCVLLDGTATLRL

SEQ ID NO: 999 - protein, 23 aa, Artificial
  synthetic human C35/gp100 polytope
TLEKITNSRPPCVVLYRYGSFSV

SEQ ID NO: 1000 - protein, 33 aa, Artificial
  synthetic human C35/gp100 polytope
VLYRYGSFSVTLEKITNSRPPCVVLYRYGSFSV

SEQ ID NO: 1001 - protein, 22 aa, Artificial
  synthetic human C35/PRAME polytope
TLEKITNSRPPCVLYVDSLFFL

SEQ ID NO: 1002 - protein, 31 aa, Artificial
  synthetic human C35/PRAME polytope
LYVDSLFFLTLEKITNSRPPCVLYVDSLFFL

SEQ ID NO: 1003 - protein, 25 aa, Artificial
  synthetic human C35/MAGE-6 polytope
TLEKITNSRPPCVKISGGPRISYPL

SEQ ID NO: 1004 - protein, 37 aa, Artificial
  synthetic human C35/MAGE-6 polytope
KISGGPRISYPLTLEKITNSRPPCVKISGGPRISYPL

SEQ ID NO: 1005 - protein, 24 aa, Artificial
  synthetic human C35/NY-ESO-1 polytope
TLEKITNSRPPCVSLLMWITQCFL

SEQ ID NO: 1006 - protein, 35 aa, Artificial
  synthetic human C35/NY-ESO-1 polytope
SLLMWITQCFLTLEKITNSRPPCVSLLMWITQCFL

SEQ ID NO: 1007 - protein, 22 aa, Artificial
  synthetic human C35/NY-ESO-1 polytope
TLEKITNSRPPCVSLLMWITQC

SEQ ID NO: 1008 - protein, 31 aa, Artificial
  synthetic human C35/NY-ESO-1 polytope
SLLMWITQCTLEKITNSRPPCVSLLMWITQC

SEQ ID NO: 1009 - protein, 22 aa, Artificial
  synthetic human C35/NY-ESO-1 polytope
TLEKITNSRPPCVQLSLLMWIT

SEQ ID NO: 1010 - protein, 31 aa, Artificial
  synthetic human C35/NY-ESO-1 polytope
QLSLLMWITTLEKITNSRPPCVQLSLLMWIT

SEQ ID NO: 1011 - protein, 42 aa, Artificial
  synthetic human C35/NY-ESO-1/MAGE-3 polytope
SLLMWITQCFLPVFTLEKITNSRPPCVTSYVKVLHHMVKISG

SEQ ID NO: 1012 - protein, 30 aa, Artificial
  synthetic human C35/MAGE-1 polytope
IRRASNGETLEKITNSRPPCVEADPTGHSY

SEQ ID NO: 1013 - protein, 39 aa, Artificial
  synthetic human C35/MAGE-1 polytope
EADPTGHSYIRRASNGETLEKITNSRPPCVEADPTGHSY

SEQ ID NO: 1014 - protein, 30 aa, Artificial
  synthetic human C35/MAGE-1 polytope
IRRASNGETLEKITNSRPPCVSAYGEPRKL

SEQ ID NO: 1015 - protein, 39 aa, Artificial
  synthetic human C35/MAGE-1 polytope
SAYGEPRKLIRRASNGETLEKITNSRPPCVSAYGEPRKL

SEQ ID NO: 1016 - protein, 30 aa, Artificial
  synthetic human C35/MAGE-3 polytope
IRRASNGETLEKITNSRPPCVEVDPIGHLY

SEQ ID NO: 1017 - protein, 39 aa, Artificial
  synthetic human C35/MAGE-3 polytope
EVDPIGHLYIRRASNGETLEKITNSRPPCVEVDPIGHLY

SEQ ID NO: 1018 - protein, 30 aa, Artificial
  synthetic human C35/MAGE-3 polytope
IRRASNGETLEKITNSRPPCVFLWGPRALV

SEQ ID NO: 1019 - protein, 39 aa, Artificial
  synthetic human C35/MAGE-3 polytope
FLWGPRALVIRRASNGETLEKITNSRPPCVFLWGPRALV

SEQ ID NO: 1020 - protein, 31 aa, Artificial
  synthetic human C35/MAGE-3 polytope
IRRASNGETLEKITNSRPPCVMEVDPIGHLY

SEQ ID NO: 1021 - protein, 41 aa, Artificial
  synthetic human C35/MAGE-3 polytope
MEVDPIGHLYIRRASNGETLEKITNSRPPCVMEVDPIGHLY

SEQ ID NO: 1022 - protein, 30 aa, Artificial
  synthetic human C35/BAGE polytope
IRRASNGETLEKITNSRPPCVAARAVFLAL

SEQ ID NO: 1023 - protein, 39 aa, Artificial
  synthetic human C35/BAGE polytope
AARAVFLALIRRASNGETLEKITNSRPPCVAARAVFLAL

SEQ ID NO: 1024 - protein, 29 aa, Artificial
  synthetic human C35/GAGE-1,2 polytope
IRRASNGETLEKITNSRPPCVYRPRPRRY

SEQ ID NO: 1025 - protein, 37 aa, Artificial
  synthetic human C35/GAGE-1,2 polytope
YRPRPRRYIRRASNGETLEKITNSRPPCVYRPRPRRY

SEQ ID NO: 1026 - protein, 31 aa, Artificial
  synthetic human C35/RAGE polytope
IRRASNGETLEKITNSRPPCVSPSSNRIRNT

SEQ ID NO: 1027 - protein, 41 aa, Artificial
  synthetic human C35/RAGE polytope
SPSSNRIRNTIRRASNGETLEKITNSRPPCVSPSSNRIRNT

SEQ ID NO: 1028 - protein, 31 aa, Artificial
  synthetic human C35/CDK4 polytope
IRRASNGETLEKITNSRPPCVARDPHSGHFV

SEQ ID NO: 1029 - protein, 41 aa, Artificial
  synthetic human C35/CDK4 polytope
ARDPHSGHFVIRRASNGETLEKITNSRPPCVARDPHSGHFV

SEQ ID NO: 1030 - protein, 30 aa, Artificial
  synthetic human C35/beta-catenin polytope
IRRASNGETLEKITNSRPPCVSYLDSGIHS

SEQ ID NO: 1031 - protein, 39 aa, Artificial
  synthetic human C35/beta-catenin polytope
SYLDSGIHSIRRASNGETLEKITNSRPPCVSYLDSGIHS

SEQ ID NO: 1032 - protein, 30 aa, Artificial
  synthetic human C35/tyrosinase polytope
IRRASNGETLEKITNSRPPCVMLLAVLYCL

SEQ ID NO: 1033 - protein, 39 aa, Artificial
  synthetic human C35/tyrosinase polytope
MLLAVLYCLIRRASNGETLEKITNSRPPCVMLLAVLYCL

SEQ ID NO: 1034 - protein, 30 aa, Artificial
  synthetic human C35/tyrosinase polytope
IRRASNGETLEKITNSRPPCVAFLPWHRLF

SEQ ID NO: 1035 - protein, 39 aa, Artificial
  synthetic human C35/tyrosinase polytope
AFLPWHRLFIRRASNGETLEKITNSRPPCVAFLPWHRLF

SEQ ID NO: 1036 - protein, 36 aa, Artificial
  synthetic human C35/tyrosinase polytope
IRRASNGETLEKITNSRPPCVQNILLSNAPLGPQFP

SEQ ID NO: 1037 - protein, 51 aa, Artificial
  synthetic human C35/tyrosinase polytope
QNILLSNAPLGPQFPIRRASNGETLEKITNSRPPCVQNILLSNAPLGPQFP

SEQ ID NO: 1038 - protein, 36 aa, Artificial
  synthetic human C35/tyrosinase polytope
IRRASNGETLEKITNSRPPCVDYSYLQDSDPDSFQD

SEQ ID NO: 1039 - protein, 51 aa, Artificial
  synthetic human C35/tyrosinase polytope
DYSYLQDSDPDSFQDIRRASNGETLEKITNSRPPCVDYSYLQDSDPDSFQD

SEQ ID NO: 1040 - protein, 30 aa, Artificial
  synthetic human C35/Melan-A polytope
IRRASNGETLEKITNSRPPCVILTVILGVL

SEQ ID NO: 1041 - protein, 39 aa, Artificial
  synthetic human C35/Melan-A polytope
ILTVILGVLIRRASNGETLEKITNSRPPCVILTVILGVL

SEQ ID NO: 1042 - protein, 30 aa, Artificial
  synthetic human C35/gp100 polytope
IRRASNGETLEKITNSRPPCVKTWGQYWQV

SEQ ID NO: 1043 - protein, 39 aa, Artificial
  synthetic human C35/gp100 polytope
KTWGQYWQVIRRASNGETLEKITNSRPPCVKTWGQYWQV

SEQ ID NO: 1044 - protein, 32 aa, Artificial
  synthetic human C35/gp100 polytope
IRRASNGETLEKITNSRPPCVILITDQVPFSV

SEQ ID NO: 1045 - protein, 41 aa, Artificial
  synthetic human C35/gp100 polytope
ITDQVPFSVIRRASNGETLEKITNSRPPCVILITDQVPFSV

SEQ ID NO: 1046 - protein, 30 aa, Artificial
  synthetic human C35/gp100 polytope
IRRASNGETLEKITNSRPPCVYLEPGPVTA

SEQ ID NO: 1047 - protein, 39 aa, Artificial
  synthetic human C35/gp100 polytope
YLEPGPVTAIRRASNGETLEKITNSRPPCVYLEPGPVTA

SEQ ID NO: 1048 - protein, 31 aa, Artificial
  synthetic human C35/gp100 polytope
IRRASNGETLEKITNSRPPCVLLDGTATLRL

SEQ ID NO: 1049 - protein, 41 aa, Artificial
  synthetic human C35/gp100 polytope
LLDGTATLRLIRRASNGETLEKITNSRPPCVLLDGTATLRL

SEQ ID NO: 1050 - protein, 31 aa, Artificial
  synthetic human C35/gp100 polytope
IRRASNGETLEKITNSRPPCVVLYRYGSFSV

SEQ ID NO: 1051 - protein, 41 aa, Artificial
  synthetic human C35/gp100 polytope
VLYRYGSFSVIRRASNGETLEKITNSRPPCVVLYRYGSFSV

SEQ ID NO: 1052 - protein, 30 aa, Artificial
  synthetic human C35/PRAME polytope
IRRASNGETLEKITNSRPPCVLYVDSLFFL

SEQ ID NO: 1053 - protein, 39 aa, Artificial
  synthetic human C35/PRAME polytope
LYVDSLFFLIRRASNGETLEKITNSRPPCVLYVDSLFFL

SEQ ID NO: 1054 - protein, 33 aa, Artificial
  synthetic human C35/MAGE-6 polytope
IRRASNGETLEKITNSRPPCVKISGGPRISYPL

SEQ ID NO: 1055 - protein, 45 aa, Artificial
  synthetic human C35/MAGE-6 polytope
KISGGPRISYPLIRRASNGETLEKITNSRPPCVKISGGPRISYPL

SEQ ID NO: 1056 - protein, 32 aa, Artificial
  synthetic human C35/NY-ESO-1 polytope
IRRASNGETLEKITNSRPPCVSLLMWITQCFL

SEQ ID NO: 1057 - protein, 43 aa, Artificial
  synthetic human C35/NY-ESO-1 polytope
SLLMWITQCFLIRRASNGETLEKITNSRPPCVSLLMWITQCFL

SEQ ID NO: 1058 - protein, 30 aa, Artificial
  synthetic human C35/NY-ESO-1 polytope
IRRASNGETLEKITNSRPPCVSLLMWITQC

SEQ ID NO: 1059 - protein, 39 aa, Artificial
  synthetic human C35/NY-ESO-1 polytope
SLLMWITQCIRRASNGETLEKITNSRPPCVSLLMWITQC

SEQ ID NO: 1060 - protein, 30 aa, Artificial
  synthetic human C35/NY-ESO-1 polytope
IRRASNGETLEKITNSRPPCVQLSLLMWIT

SEQ ID NO: 1061 - protein, 39 aa, Artificial
  synthetic human C35/NY-ESO-1 polytope
QLSLLMWITIRRASNGETLEKITNSRPPCVQLSLLMWIT

SEQ ID NO: 1062 - protein, 50 aa, Artificial
  synthetic human C35/NY-ESO-1/MAGE-3 polytope
SLLMWITQCFLPVFIRRASNGETLEKITNSRPPCVTSYVKVLHHMVKISG

SEQ ID NO: 1063 - protein, 35 aa, Artificial
  synthetic human C35/MAGE-1 polytope
DLIEAIRRASNGETLEKITNSRPPCVEADPTGHSY

SEQ ID NO: 1064 - protein, 44 aa, Artificial
  synthetic human C35/MAGE-1 polytope
EADPTGHSYDLIEAIRRASNGETLEKITNSRPPCVEADPTGHSY

SEQ ID NO: 1065 - protein, 35 aa, Artificial
  synthetic human C35/MAGE-1 polytope
DLIEAIRRASNGETLEKITNSRPPCVSAYGEPRKL

SEQ ID NO: 1066 - protein, 44 aa, Artificial
  synthetic human C35/MAGE-1 polytope
SAYGEPRKLDLIEAIRRASNGETLEKITNSRPPCVSAYGEPRKL

SEQ ID NO: 1067 - protein, 35 aa, Artificial
  synthetic human C35/MAGE-3 polytope
DLIEAIRRASNGETLEKITNSRPPCVEVDPIGHLY

SEQ ID NO: 1068 - protein, 44 aa, Artificial
  synthetic human C35/MAGE-3 polytope
EVDPIGHLYDLIEAIRRASNGETLEKITNSRPPCVEVDPIGHLY

SEQ ID NO: 1069 - protein, 35 aa, Artificial
  synthetic human C35/MAGE-3 polytope
DLIEAIRRASNGETLEKITNSRPPCVFLWGPRALV

SEQ ID NO: 1070 - protein, 44 aa, Artificial
  synthetic human C35/MAGE-3 polytope
FLWGPRALVDLIEAIRRASNGETLEKITNSRPPCVFLWGPRALV

SEQ ID NO: 1071 - protein, 36 aa, Artificial
  synthetic human C35/MAGE-3 polytope
DLIEAIRRASNGETLEKITNSRPPCVMEVDPIGHLY

SEQ ID NO: 1072 - protein, 46 aa, Artificial
  synthetic human C35/MAGE-3 polytope
MEVDPIGHLYDLIEAIRRASNGETLEKITNSRPPCVMEVDPIGHLY

SEQ ID NO: 1073 - protein, 35 aa, Artificial
  synthetic human C35/BAGE polytope
DLIEAIRRASNGETLEKITNSRPPCVAARAVFLAL

SEQ ID NO: 1074 - protein, 43 aa, Artificial
  synthetic human C35/BAGE polytope
AARAVFLALDLIEAIRRASNGETLEKITNSRPPCVAARVFLAL

SEQ ID NO: 1075 - protein, 34 aa, Artificial
  synthetic human C35/GAGE-1,2 polytope
DLIEAIRRASNGETLEKITNSRPPCVYRPRPRRY

SEQ ID NO: 1076 - protein, 42 aa, Artificial
  synthetic human C35/GAGE-1,2 polytope
YRPRPRRYDLIEAIRRASNGETLEKITNSRPPCVYRPRPRRY

SEQ ID NO: 1077 - protein, 36 aa, Artificial
  synthetic human C35/RAGE polytope
DLIEAIRRASNGETLEKITNSRPPCVSPSSNRIRNT

SEQ ID NO: 1078 - protein, 46 aa, Artificial
  synthetic human C35/RAGE polytope
SPSSNRIRNTDLIEAIRRASNGETLEKITNSRPPCVSPSSNRIRNT

SEQ ID NO: 1079 - protein, 36 aa, Artificial
  synthetic human C35/CDK4 polytope
DLIEAIRRASNGETLEKITNSRPPCVARDPHSGHFV

SEQ ID NO: 1080 - protein, 46 aa, Artificial
  synthetic human C35/CDK4 polytope
ARDPHSGHFVDLIEAIRRASNGETLEKITNSRPPCVARDPHSGHFV

SEQ ID NO: 1081 - protein, 35 aa, Artificial
  synthetic human C35/beta-catenin polytope
DLIEAIRRASNGETLEKITNSRPPCVSYLDSGIHS

SEQ ID NO: 1082 - protein, 44 aa, Artificial
  synthetic human C35/beta-catenin polytope
SYLDSGIHSDLIEAIRRASNGETLEKITNSRPPCVSYLDSGIHS

SEQ ID NO: 1083 - protein, 35 aa, Artificial
  synthetic human C35/tyrosinase polytope
DLIEAIRRASNGETLEKITNSRPPCVMLLAVLYCL

SEQ ID NO: 1084 - protein, 44 aa, Artificial
  synthetic human C35/tyrosinase polytope
MLLAVLYCLDLIEAIRRASNGETLEKITNSRPPCVMLLAVLYCL

SEQ ID NO: 1085 - protein, 35 aa, Artificial
  synthetic human C35/tyrosinase polytope
DLIEAIRRASNGETLEKITNSRPPCVAFLPWHRLF

SEQ ID NO: 1086 - protein, 44 aa, Artificial
  synthetic human C35/tyrosinase polytope
AFLPWHRLFDLIEAIRRASNGETLEKITNSRPPCVAFLPWHRLF

SEQ ID NO: 1087 - protein, 41 aa, Artificial
  synthetic human C35/tyrosinase polytope
DLIEAIRRASNGETLEKITNSRPPCVQNILLSNAPLGPQFP

SEQ ID NO: 1088 - protein, 56 aa, Artificial
  synthetic human C35/tyrosinase polytope
QNILLSNAPLGPQFPDLIEAIRRASNGETLEKITNSRPPCVQNILLSNAPLGPQFP

SEQ ID NO: 1089 - protein, 41 aa, Artificial
  synthetic human C35/tyrosinase polytope
DLIEAIRRASNGETLEKITNSRPPCVDYSYLQDSDPDSFQD

SEQ ID NO: 1090 - protein, 56 aa, Artificial
  synthetic human C35/tyrosinase polytope
DYSYLQDSDPDSFQDDLIEAIRRASNGETLEKITNSRPPCVDYSYLQDSDPDSFQD

SEQ ID NO: 1091 - protein, 35 aa, Artificial
  synthetic human C35/Melan-A polytope
DLIEAIRRASNGETLEKITNSRPPCVILTVILGVL

SEQ ID NO: 1092 - protein, 44 aa, Artificial
  synthetic human C35/Melan-A polytope
ILTVILGVLDLIEAIRRASNGETLEKITNSRPPCVILTVILGVL

SEQ ID NO: 1093 - protein, 35 aa, Artificial
  synthetic human C35/gp100 polytope
DLIEAIRRASNGETLEKITNSRPPCVKTWGQYWQV

SEQ ID NO: 1094 - protein, 44 aa, Artificial
  synthetic human C35/gp100 polytope
KTWGQYWQVDLIEAIRRASNGETLEKITNSRPPCVKTWGQYWQV

SEQ ID NO: 1095 - protein, 35 aa, Artificial
  synthetic human C35/gp100 polytope
DLIEAIRRASNGETLEKITNSRPPCVITDQVPFSV

SEQ ID NO: 1096 - protein, 44 aa, Artificial
  synthetic human C35/gp100 polytope
ITDQVPFSVDLIEAIRRASNGETLEKITNSRPPCVITDQVPFSV

SEQ ID NO: 1097 - protein, 35 aa, Artificial
  synthetic human C35/gp100 polytope
DLIEAIRRASNGETLEKITNSRPPCVYLEPGPVTA

SEQ ID NO: 1098 - protein, 44 aa, Artificial
  synthetic human C35/gp100 polytope
YLEPGPVTADLIEAIRRASNGETLEKITNSRPPCVYLEPGPVTA

SEQ ID NO: 1099 - protein, 36 aa, Artificial
  synthetic human C35/gp100 polytope
DLIEAIRRASNGETLEKITNSRPPCVLLDGTATLRL

SEQ ID NO: 1100 - protein, 46 aa, Artificial
  synthetic human C35/gp100 polytope
LLDGTATLRLDLIEAIRRASNGETLEKITNSRPPCVLLDGTATLRL

SEQ ID NO: 1101 - protein, 36 aa, Artificial
  synthetic human C35/gp100 polytope
DLIEAIRRASNGETLEKITNSRPPCVVLYRYGSFSV

SEQ ID NO: 1102 - protein, 46 aa, Artificial
  synthetic human C35/gp100 polytope
VLYRYGSFSVDLIEAIRRASNGETLEKITNSRPPCVVLYRYGSFSV

SEQ ID NO: 1103 - protein, 35 aa, Artificial
  synthetic human C35/PRAME polytope
DLIEAIRRASNGETLEKITNSRPPCVLYVDSLFFL

SEQ ID NO: 1104 - protein, 44 aa, Artificial
  synthetic human C35/PRAME polytope
LYVDSLFFLDLIEAIRRASNGETLEKITNSRPPCVLYVDSLFFL

SEQ ID NO: 1105 - protein, 38 aa, Artificial
  synthetic human C35/MAGE-6 polytope
DLIEAIRRASNGETLEKITNSRPPCVKISGGPRISYPL

SEQ ID NO: 1106 - protein, 50 aa, Artificial
  synthetic human C35/MAGE-6 polytope
KISGGPRISYPLDLIEAIRRASNGETLEKITNSRPPCVKISGGPRISYPL

SEQ ID NO: 1107 - protein, 37 aa, Artificial
  synthetic human C35/NY-ESO-1 polytope
DLIEAIRRASNGETLEKITNSRPPCVSLLMWITQCFL

SEQ ID NO: 1108 - protein, 48 aa, Artificial
  synthetic human C35/NY-ESO-1 polytope
SLLMWITQCFLDLIEAIRRASNGETLEKITNSRPPCVSLLMWITQCFL

SEQ ID NO: 1109 - protein, 35 aa, Artificial
  synthetic human C35/NY-ESO-1 polytope
DLIEAIRRASNGETLEKITNSRPPCVSLLMWITQC

SEQ ID NO: 1110 - protein, 44 aa, Artificial
  synthetic human C35/NY-ESO-1 polytope
SLLMWITQCDLIEAIRRASNGETLEKITNSRPPCVSLLMWITQC

SEQ ID NO: 1111 - protein, 35 aa, Artificial
  synthetic human C35/NY-ESO-1 polytope
DLIEAIRRASNGETLEKITNSRPPCVQLSLLMWIT

SEQ ID NO: 1112 - protein, 44 aa, Artificial
  synthetic human C35/NY-ESO-1 polytope
QLSLLMWITDLIEAIRRASNGETLEKITNSRPPCVQLSLLMWIT

SEQ ID NO: 1113 - protein, 55 aa, Artificial
  synthetic human C35/NY-ESO-1/MAGE-3 polytope
SLLMWITQCFLPVFDLIEAIRRASNGETLEKITNSRPPCVTSYVKVLHHMVKISG

SEQ ID NO: 1114 - protein, 39 aa, Artificial
  synthetic human C35/MAGE-1 polytope
PYEKDLIEAIRRASNGETLEKITNSRPPCVEADPTGHSY

SEQ ID NO: 1115 - protein, 48 aa, Artificial
  synthetic human C35/MAGE-1 polytope
EADPTGHSYPYEKDLIEAIRRASNGETLEKITNSRPPCVEADPTGHSY

SEQ ID NO: 1116 - protein, 39 aa, Artificial
  synthetic human C35/MAGE-1 polytope
PYEKDLIEAIRRASNGETLEKITNSRPPCVSAYGEPRKL

SEQ ID NO: 1117 - protein, 48 aa, Artificial
  synthetic human C35/MAGE-1 polytope
SAYGEPRKLPYEKDLIEAIRRASNGETLEKITNSRPPCVSAYGEPRKL

SEQ ID NO: 1118 - protein, 48 aa, Artificial; identical to SEQ ID NO: 1117
  synthetic human C35/MAGE-3 polytope

SEQ ID NO: 1119 - protein, 48 aa, Artificial
  synthetic human C35/MAGE-3 polytope
EVDPIGHLYPYEKDLIEAIRRASNGETLEKITNSRPPCVEVDPIGHLY

SEQ ID NO: 1120 - protein, 39 aa, Artificial
  synthetic human C35/MAGE-3 polytope
PYEKDLIEAIRRASNGETLEKITNSRPPCVFLWGPRALV

SEQ ID NO: 1121 - protein, 48 aa, Artificial
  synthetic human C35/MAGE-3 polytope
FLWGPRALVPYEKDLIEAIRRASNGETLEKITNSRPPCVFLWGPRALV

SEQ ID NO: 1122 - protein, 40 aa, Artificial
  synthetic human C35/MAGE-3 polytope
PYEKDLIEAIRRASNGETLEKITNSRPPCVMEVDPIGHLY

SEQ ID NO: 1123 - protein, 50 aa, Artificial
  synthetic human C35/MAGE-3 polytope
MEVDPIGHLYPYEKDLIEAIRRASNGETLEKITNSRPPCVMEVDPIGHLY

SEQ ID NO: 1124 - protein, 39 aa, Artificial
  synthetic human C35/BAGE polytope
PYEKDLIEAIRRASNGETLEKITNSRPPCVAARAVFLAL

SEQ ID NO: 1125 - protein, 48 aa, Artificial
  synthetic human C35/BAGE polytope
AARAVFLALPYEKDLIEAIRRASNGETLEKITNSRPPCVAARAVFLAL

SEQ ID NO: 1126 - protein, 38 aa, Artificial
  synthetic human C35/GAGE-1,2 polytope
PYEKDLIEAIRRASNGETLEKITNSRPPCVYRPRPRRY

SEQ ID NO: 1127 - protein, 46 aa, Artificial
  synthetic human C35/GAGE-1,2 polytope
YRPRPRRYPYEKDLIEAIRRASNGETLEKITNSRPPCVYRPRPRRY

SEQ ID NO: 1128 - protein, 40 aa, Artificial
  synthetic human C35/RAGE polytope
PYEKDLIEAIRRASNGETLEKITNSRPPCVSPSSNRIRNT

SEQ ID NO: 1129 - protein, 50 aa, Artificial
  synthetic human C35/RAGE polytope
SPSSNRIRNTPYEKDLIEAIRRASNGETLEKITNSRPPCVSPSSNRIRNT

SEQ ID NO: 1130 - protein, 40 aa, Artificial
  synthetic human C35/CDK4 polytope
PYEKDLIEAIRRASNGETLEKITNSRPPCVARDPHSGHFV

SEQ ID NO: 1131 - protein, 50 aa, Artificial
  synthetic human C35/CDK4 polytope
ARDPHSGHFVPYEKDLIEAIRRASNGETLEKITNSRPPCVARDPHSGHFV

SEQ ID NO: 1132 - protein, 39 aa, Artificial
  synthetic human C35/beta-catenin polytope
PYEKDLIEAIRRASNGETLEKITNSRPPCVSYLDSGIHS

SEQ ID NO: 1133 - protein, 48 aa, Artificial
  synthetic human C35/beta-catenin polytope
SYLDSGIHSPYEKDLIEAIRRASNGETLEKITNSRPPCVSYLDSGIHS

SEQ ID NO: 1134 - protein, 39 aa, Artificial
  synthetic human C35/tyrosinase polytope
PYEKDLIEAIRRASNGETLEKITNSRPPCVMLLAVLYCL

SEQ ID NO: 1135 - protein, 48 aa, Artificial
  synthetic human C35/tyrosinase polytope
MLLAVLYCLPYEKDLIEAIRRASNGETLEKITNSRPPCVMLLAVLYCL

SEQ ID NO: 1136 - protein, 39 aa, Artificial
  synthetic human C35/tyrosinase polytope
PYEKDLIEAIRRASNGETLEKITNSRPPCVAFLPWHRLF

SEQ ID NO: 1137 - protein, 48 aa, Artificial
  synthetic human C35/tyrosinase polytope
AFLPWHRLFPYEKDLIEAIRRASNGETLEKITNSRPPCVAFLPWHRLF

SEQ ID NO: 1138 - protein, 45 aa, Artificial
  synthetic human C35/tyrosinase polytope
PYEKDLIEAIRRASNGETLEKITNSRPPCVQNILLSNAPLGPQFP

SEQ ID NO: 1139 - protein, 60 aa, Artificial
  synthetic human C35/tyrosinase polytope
QNILLSNAPLGPQFPPYEKDLIEAIRRASNGETLEKITNSRPPCVQNILLSNAPLGPQFP

SEQ ID NO: 1140 - protein, 45 aa, Artificial
  synthetic human C35/tyrosinase polytope
PYEKDLIEAIRRASNGETLEKITNSRPPCVDYSYLQDSDPDSFQD

SEQ ID NO: 1141 - protein, 60 aa, Artificial
  synthetic human C35/tyrosinase polytope
DYSYLQDSDPDSFQDPYEKDLIEAIRRASNGETLEKITNSRPPCVDYSYLQDSDPDSFQD

SEQ ID NO: 1142 - protein, 39 aa, Artificial
  synthetic human C35/Melan-A polytope
PYEKDLIEAIRRASNGETLEKITNSRPPCVILTVILGVL

SEQ ID NO: 1143 - protein, 48 aa, Artificial
  synthetic human C35/Melan-A polytope
ILTVILGVLPYEKDLIEAIRRASNGETLEKITNSRPPCVILTVILGVL

SEQ ID NO: 1144 - protein, 39 aa, Artificial
  synthetic human C35/gp100 polytope
PYEKDLIEAIRRASNGETLEKITNSRPPCVKTWGQYWQV

SEQ ID NO: 1145 - protein, 48 aa, Artificial
  synthetic human C35/gp100 polytope
KTWGQYWQVPYEKDLIEAIRRASNGETLEKITNSRPPCVKTWGQYWQV

SEQ ID NO: 1146 - protein, 39 aa, Artificial
  synthetic human C35/gp100 polytope
PYEKDLIEAIRRASNGETLEKITNSRPPCVITDQVPFSV

SEQ ID NO: 1147 - protein, 48 aa, Artificial
  synthetic human C35/gp100 polytope
ITDQVPFSVPYEKDLIEAIRRASNGETLEKITNSRPPCVITDQVPFSV

SEQ ID NO: 1148 - protein, 39 aa, Artificial
  synthetic human C35/gp100 polytope
PYEKDLIEAIRRASNGETLEKITNSRPPCVYLEPGPVTA

SEQ ID NO: 1149 - protein, 48 aa, Artificial
  synthetic human C35/gp100 polytope
YLEPGPVTAPYEKDLIEAIRRASNGETLEKITNSRPPCVYLEPGPVTA

SEQ ID NO: 1150 - protein, 40 aa, Artificial
  synthetic human C35/gp100 polytope
PYEKDLIEAIRRASNGETLEKITNSRPPCVLLDGTATLRL

SEQ ID NO: 1151 - protein, 50 aa, Artificial
  synthetic human C35/gp100 polytope
LLDGTATLRLPYEKDLIEAIRRASNGETLEKITNSRPPCVLLDGTATLRL

SEQ ID NO: 1152 - protein, 40 aa, Artificial
  synthetic human C35/gp100 polytope
PYEKDLIEAIRRASNGETLEKITNSRPPCVVLYRYGSFSV

SEQ ID NO: 1153 - protein, 50 aa, Artificial
  synthetic human C35/gp100 polytope
VLYRYGSFSVPYEKDLIEAIRRASNGETLEKITNSRPPCVVLYRYGSFSV

SEQ ID NO: 1154 - protein, 39 aa, Artificial
  synthetic human C35/PRAME polytope
PYEKDLIEAIRRASNGETLEKITNSRPPCVLYVDSLFFL

SEQ ID NO: 1155 - protein, 48 aa, Artificial
  synthetic human C35/PRAME polytope
LYVDSLFFLPYEKDLIEAIRRASNGETLEKITNSRPPCVLYVDSLFFL

SEQ ID NO: 1156 - protein, 42 aa, Artificial
  synthetic human C35/MAGE-6 polytope
PYEKDLIEAIRRASNGETLEKITNSRPPCVKISGGPRISYPL

SEQ ID NO: 1157 - protein, 54 aa, Artificial
  synthetic human C35/MAGE-6 polytope
KISGGPRISYPLPYEKDLIEAIRRASNGETLEKITNSRPPCVKISGGPRISYPL

SEQ ID NO: 1158 - protein, 41 aa, Artificial
  synthetic human C35/NY-ESO-1 polytope
PYEKDLIEAIRRASNGETLEKITNSRPPCVSLLMWITQCFL

SEQ ID NO: 1159 - protein, 52 aa, Artificial
  synthetic human C35/NY-ESO-1 polytope
SLLMWITQCFLPYEKDLIEAIRRASNGETLEKITNSRPPCVSLLMWITQCFL

SEQ ID NO: 1160 - protein, 39 aa, Artificial
  synthetic human C35/NY-ESO-1 polytope
PYEKDLIEAIRRASNGETLEKITNSRPPCVSLLMWITQC

SEQ ID NO: 1161 - protein, 48 aa, Artificial
  synthetic human C35/NY-ESO-1 polytope
SLLMWITQCPYEKDLIEAIRRASNGETLEKITNSRPPCVSLLMWITQC

SEQ ID NO: 1162 - protein, 39 aa, Artificial
  synthetic human C35/NY-ESO-1 polytope
PYEKDLIEAIRRASNGETLEKITNSRPPCVQLSLLMWIT

SEQ ID NO: 1163 - protein, 48 aa, Artificial
  synthetic human C35/NY-ESO-1 polytope
QLSLLMWITPYEKDLIEAIRRASNGETLEKITNSRPPCVQLSLLMWIT

SEQ ID NO: 1164 - protein, 59 aa, Artificial
  synthetic human C35/NY-ESO-1/MAGE-3 polytope
SLLMWITQCFLPVFPYEKDLIEAIRRASNGETLEKITNSRPPCVTSYVKVLHHMVKISG

SEQ ID NO: 1165 - protein, 46 aa, Artificial
  synthetic human C35/MAGE-1 polytope
KLENGGFPYEKDLIEAIRRASNGETLEKITNSRPPCVEADPTGHSY

SEQ ID NO: 1166 - protein, 55 aa, Artificial
  synthetic human C35/MAGE-1 polytope
EADPTGHSYKLENGGFPYEKDLIEAIRRASNGETLEKITNSRPPCVEADPTGHSY

SEQ ID NO: 1167 - protein, 46 aa, Artificial
  synthetic human C35/MAGE-1 polytope
KLENGGFPYEKDLIEAIRRASNGETLEKITNSRPPCVSAYGEPRKL

SEQ ID NO: 1168 - protein, 55 aa, Artificial
  synthetic human C35/MAGE-1 polytope
SAYGEPRKLKLENGGFPYEKDLIEAIRRASNGETLEKITNSRPPCVSAYGEPRKL

SEQ ID NO: 1169 - protein, 46 aa, Artificial
  synthetic human C35/MAGE-3 polytope
KLENGGFPYEKDLIEAIRRASNGETLEKITNSRPPCVEVDPIGHLY

SEQ ID NO: 1170 - protein, 55 aa, Artificial
  synthetic human C35/MAGE-3 polytope
EVDPIGHLYKLENGGFPYEKDLIEAIRRASNGETLEKITNSRPPCVEVDPIGHLY

SEQ ID NO: 1171 - protein, 46 aa, Artificial
  synthetic human C35/MAGE-3 polytope
KLENGGFPYEKDLIEAIRRASNGETLEKITNSRPPCVFLWGPRALV

SEQ ID NO: 1172 - protein, 55 aa, Artificial
  synthetic human C35/MAGE-3 polytope
FLWGPRALVKLENGGFPYEKDLIEAIRRASNGETLEKITNSRPPCVFLWGPRALV

SEQ ID NO: 1173 - protein, 47 aa, Artificial
  synthetic human C35/MAGE-3 polytope
KLENGGFPYEKDLIEAIRRASNGETLEKITNSRPPCVMEVDPIGHLY

SEQ ID NO: 1174 - protein, 57 aa, Artificial
  synthetic human C35/MAGE-3 polytope
MEVDPIGHLYKLENGGFPYEKDLIEAIRRASNGETLEKITNSRPPCVMEVDPIGHLY

SEQ ID NO: 1175 - protein, 46 aa, Artificial
  synthetic human C35/BAGE polytope
KLENGGFPYEKDLIEAIRRASNGETLEKITNSRPPCVAARAVFLAL

SEQ ID NO: 1176 - protein, 55 aa, Artificial
  synthetic human C35/BAGE polytope
AARAVFLALKLENGGFPYEKDLIEAIRRASNGETLEKITNSRPPCVAARAVFLAL

SEQ ID NO: 1177 - protein, 45 aa, Artificial
  synthetic human C35/GAGE-1,2 polytope
KLENGGFPYEKDLIEAIRRASNGETLEKITNSRPPCVYRPRPRRY

SEQ ID NO: 1178 - protein, 53 aa, Artificial
  synthetic human C35/GAGE-1,2 polytope
YRPRPRRYKLENGGFPYEKDLIEAIRRASNGETLEKITNSRPPCVYRPRPRRY

SEQ ID NO: 1179 - protein, 47 aa, Artificial
  synthetic human C35/RAGE polytope
KLENGGFPYEKDLIEAIRRASNGETLEKITNSRPPCVSPSSNRIRNT

SEQ ID NO: 1180 - protein, 57 aa, Artificial
  synthetic human C35/RAGE polytope
SPSSNRIRNTKLENGGFPYEKDLIEAIRRASNGETLEKITNSRPPCVSPSSNRIRNT

SEQ ID NO: 1181 - protein, 47 aa, Artificial
  synthetic human C35/CDK4 polytope
KLENGGFPYEKDLIEAIRRASNGETLEKITNSRPPCVARDPHSGHFV

SEQ ID NO: 1182 - protein, 57 aa, Artificial
  synthetic human C35/CDK4 polytope
ARDPHSGHFVKLENGGFPYEKDLIEAIRRASNGETLEKITNSRPPCVARDPHSGHFV

SEQ ID NO: 1183 - protein, 46 aa, Artificial
  synthetic human C35/beta-catenin polytope
KLENGGFPYEKDLIEAIRRASNGETLEKITNSRPPCVSYLDSGIHS

SEQ ID NO: 1184 - protein, 55 aa, Artificial
  synthetic human C35/beta-catenin polytope
SYLDSGIHSKLENGGFPYEKDLIEAIRRASNGETLEKITNSRPPCVSYLDSGIHS

SEQ ID NO: 1185 - protein, 46 aa, Artificial
  synthetic human C35/tyrosinase polytope
KLENGGFPYEKDLIEAIRRASNGETLEKITNSRPPCVMLLAVLYCL

SEQ ID NO: 1186 - protein, 55 aa, Artificial
  synthetic human C35/tyrosinase polytope
MLLAVLYCLKLENGGFPYEKDLIEAIRRASNGETLEKITNSRPPCVMLLAVLYCL

SEQ ID NO: 1187 - protein, 46 aa, Artificial
  synthetic human C35/tyrosinase polytope
KLENGGFPYEKDLIEAIRRASNGETLEKITNSRPPCVAFLPWHRLF

SEQ ID NO: 1188 - protein, 55 aa, Artificial
  synthetic human C35/tyrosinase polytope
AFLPWHRLFKLENGGFPYEKDLIEAIRRASNGETLEKITNSRPPCVAFLPWHRLF

SEQ ID NO: 1189 - protein, 52 aa, Artificial
  synthetic human C35/tyrosinase polytope
KLENGGFPYEKDLIEAIRRASNGETLEKITNSRPPCVQNILLSNAPLGPQFP

SEQ ID NO: 1190 - protein, 67 aa, Artificial
  synthetic human C35/tyrosinase polytope
QNILLSNAPLGPQFPKLENGGFPYEKDLIEAIRRASNGETLEKITNSRPPCVQNILLSNAPLGPQFP

SEQ ID NO: 1191 - protein, 52 aa, Artificial
  synthetic human C35/tyrosinase polytope
KLENGGFPYEKDLIEAIRRASNGETLEKITNSRPPCVDYSYLQDSDPDSFQD

SEQ ID NO: 1192 - protein, 67 aa, Artificial
  synthetic human C35/tyrosinase polytope
DYSYLQDSDPDSFQDKLENGGFPYEKDLIEAIRRASNGETLEKITNSRPPCVDYSYLQDSDPDSFQD

SEQ ID NO: 1193 - protein, 46 aa, Artificial
  synthetic human C35/Melan-A polytope
KLENGGFPYEKDLIEAIRRASNGETLEKITNSRPPCVILTVILGVL

SEQ ID NO: 1194 - protein, 55 aa, Artificial
  synthetic human C35/Melan-A polytope
ILTVILGVLKLENGGFPYEKDLIEAIRRASNGETLEKITNSRPPCVILTVILGVL

SEQ ID NO: 1195 - protein, 46 aa, Artificial
  synthetic human C35/gp100 polytope
KLENGGFPYEKDLIEAIRRASNGETLEKITNSRPPCVKTWGQYWQV

SEQ ID NO: 1196 - protein, 55 aa, Artificial
  synthetic human C35/gp100 polytope
KTWGQYWQVKLENGGFPYEKDLIEAIRRASNGETLEKITNSRPPCVKTWGQYWQV

SEQ ID NO: 1197 - protein, 48 aa, Artificial
  synthetic human C35/gp100 polytope
KLENGGFPYEKDLIEAIRRASNGETLEKITNSRPPCVILITDQVPFSV

SEQ ID NO: 1198 - protein, 57 aa, Artificial
  synthetic human C35/gp100 polytope
ITDQVPFSVKLENGGFPYEKDLIEAIRRASNGETLEKITNSRPPCVILITDQVPFSV

SEQ ID NO: 1199 - protein, 46 aa, Artificial
  synthetic human C35/gp100 polytope
KLENGGFPYEKDLIEAIRRASNGETLEKITNSRPPCVYLEPGPVTA

SEQ ID NO: 1200 - protein, 55 aa, Artificial
  synthetic human C35/gp100 polytope
YLEPGPVTAKLENGGFPYEKDLIEAIRRASNGETLEKITNSRPPCVYLEPGPVTA

SEQ ID NO: 1201 - protein, 47 aa, Artificial
  synthetic human C35/gp100 polytope
KLENGGFPYEKDLIEAIRRASNGETLEKITNSRPPCVLLDGTATLRL

SEQ ID NO: 1202 - protein, 57 aa, Artificial
  synthetic human C35/gp100 polytope
LLDGTATLRLKLENGGFPYEKDLIEAIRRASNGETLEKITNSRPPCVLLDGTATLRL

SEQ ID NO: 1203 - protein, 47 aa, Artificial
  synthetic human C35/gp100 polytope
KLENGGFPYEKDLIEAIRRASNGETLEKITNSRPPCVVLYRYGSFSV

SEQ ID NO: 1204 - protein, 57 aa, Artificial
  synthetic human C35/gp100 polytope
VLYRYGSFSVKLENGGFPYEKDLIEAIRRASNGETLEKITNSRPPCVVLYRYGSFSV

SEQ ID NO: 1205 - protein, 46 aa, Artificial
  synthetic human C35/PRAME polytope
KLENGGFPYEKDLIEAIRRASNGETLEKITNSRPPCVLYVDSLFFL

SEQ ID NO: 1206 - protein, 55 aa, Artificial
  synthetic human C35/PRAME polytope
LYVDSLFFLKLENGGFPYEKDLIEAIRRASNGETLEKITNSRPPCVLYVDSLFFL

SEQ ID NO: 1207 - protein, 49 aa, Artificial
  synthetic human C35/MAGE-6 polytope
KLENGGFPYEKDLIEAIRRASNGETLEKITNSRPPCVKISGGPRISYPL

SEQ ID NO: 1208 - protein, 61 aa, Artificial
  synthetic human C35/MAGE-6 polytope
KISGGPRISYPLKLENGGFPYEKDLIEAIRRASNGETLEKITNSRPPCVKISGGPRISYPL

SEQ ID NO: 1209 - protein, 48 aa, Artificial
  synthetic human C35/NY-ESO-1 polytope
KLENGGFPYEKDLIEAIRRASNGETLEKITNSRPPCVSLLMWITQCFL

SEQ ID NO: 1210 - protein, 59 aa, Artificial
  synthetic human C35/NY-ESO-1 polytope
SLLMWITQCFLKLENGGFPYEKDLIEAIRRASNGETLEKITNSRPPCVSLLMWITQCFL

SEQ ID NO: 1211 - protein, 46 aa, Artificial
  synthetic human C35/NY-ESO-1 polytope
KLENGGFPYEKDLIEAIRRASNGETLEKITNSRPPCVSLLMWITQC

SEQ ID NO: 1212 - protein, 55 aa, Artificial
  synthetic human C35/NY-ESO-1 polytope
SLLMWITQCKLENGGFPYEKDLIEAIRRASNGETLEKITNSRPPCVSLLMWITQC

SEQ ID NO: 1213 - protein, 46 aa, Artificial
  synthetic human C35/NY-ESO-1 polytope
KLENGGFPYEKDLIEAIRRASNGETLEKITNSRPPCVQLSLLMWIT

SEQ ID NO: 1214 - protein, 55 aa, Artificial
  synthetic human C35/NY-ESO-1 polytope
QLSLLMWITKLENGGFPYEKDLIEAIRRASNGETLEKITNSRPPCVQLSLLMWIT

SEQ ID NO: 1215 - protein, 66 aa, Artificial
  synthetic human C35/NY-ESO-1/MAGE-3 polytope
SLLMWITQCFLPVFKLENGGFPYEKDLIEAIRRASNGETLEKITNSRPPCVTSYVKVLHHMVKISG

SEQ ID NO: 1216 - protein, 51 aa, Artificial
  synthetic human C35/MAGE-1 polytope
QLVFSKLENGGFPYEKDLIEAIRRASNGETLEKITNSRPPCVEADPTGHSY

SEQ ID NO: 1217 - protein, 60 aa, Artificial
  synthetic human C35/MAGE-1 polytope
EADPTGHSYQLVFSKLENGGFPYEKDLIEAIRRASNGETLEKITNSRPPCVEADPTGHSY

SEQ ID NO: 1218 - protein, 51 aa, Artificial
  synthetic human C35/MAGE-1 polytope
QLVFSKLENGGFPYEKDLIEAIRRASNGETLEKITNSRPPCVSAYGEPRKL

SEQ ID NO: 1219 - protein, 60 aa, Artificial
  synthetic human C35/MAGE-1 polytope
SAYGEPRKLQLVFSKLENGGFPYEKDLIEAIRRASNGETLEKITNSRPPCVSAYGEPRKL

SEQ ID NO: 1220 - protein, 51 aa, Artificial
  synthetic human C35/MAGE-3 polytope
QLVFSKLENGGFPYEKDLIEAIRRASNGETLEKITNSRPPCVEVDPIGHLY

SEQ ID NO: 1221 - protein, 60 aa, Artificial
  synthetic human C35/MAGE-3 polytope
EVDPIGHLYQLVFSKLENGGFPYEKDLIEAIRRASNGETLEKITNSRPPCVEVDPIGHLY

SEQ ID NO: 1222 - protein, 51 aa, Artificial
  synthetic human C35/MAGE-3 polytope
QLVFSKLENGGFPYEKDLIEAIRRASNGETLEKITNSRPPCVFLWGPRALV

SEQ ID NO: 1223 - protein, 60 aa, Artificial
  synthetic human C35/MAGE-3 polytope
FLWGPRALVQLVFSKLENGGFPYEKDLIEAIRRASNGETLEKITNSRPPCVFLWGPRALV

SEQ ID NO: 1224 - protein, 52 aa, Artificial
  synthetic human C35/MAGE-3 polytope
QLVFSKLENGGFPYEKDLIEAIRRASNGETLEKITNSRPPCVMEVDPIGHLY

SEQ ID NO: 1225 - protein, 62 aa, Artificial
  synthetic human C35/MAGE-3 polytope
MEVDPIGHLYQLVFSKLENGGFPYEKDLIEAIRRASNGETLEKITNSRPPCVMEVDPIGHLY

SEQ ID NO: 1226 - protein, 51 aa, Artificial
  synthetic human C35/BAGE polytope
QLVFSKLENGGFPYEKDLIEAIRRASNGETLEKITNSRPPCVAARAVFLAL

SEQ ID NO: 1227 - protein, 60 aa, Artificial
  synthetic human C35/BAGE polytope
AARAVFLALQLVFSKLENGGFPYEKDLIEAIRRASNGETLEKITNSRPPCVAARAVFLAL

SEQ ID NO: 1228 - protein, 50 aa, Artificial
  synthetic human C35/GAGE-1,2 polytope
QLVFSKLENGGFPYEKDLIEAIRRASNGETLEKITNSRPPCVYRPRPRRY

SEQ ID NO: 1229 - protein, 58 aa, Artificial
  synthetic human C35/GAGE-1,2 polytope
YRPRPRRYQLVFSKLENGGFPYEKDLIEAIRRASNGETLEKITNSRPPCVYRPRPRRY

SEQ ID NO: 1230 - protein, 52 aa, Artificial
  synthetic human C35/RAGE polytope
QLVFSKLENGGFPYEKDLIEAIRRASNGETLEKITNSRPPCVSPSSNRIRNT

SEQ ID NO: 1231 - protein, 62 aa, Artificial
  synthetic human C35/RAGE polytope
SPSSNRIRNTQLVFSKLENGGFPYEKDLIEAIRRASNGETLEKITNSRPPCVSPSSNRIRNT

SEQ ID NO: 1232 - protein, 52 aa, Artificial
  synthetic human C35/CDK4 polytope
QLVFSKLENGGFPYEKDLIEAIRRASNGETLEKITNSRPPCVARDPHSGHFV

SEQ ID NO: 1233 - protein, 62 aa, Artificial
  synthetic human C35/CDK4 polytope
ARDPHSGHFVQLVFSKLENGGFPYEKDLIEAIRRASNGETLEKITNSRPPCVARDPHSGHFV

SEQ ID NO: 1234 - protein, 51 aa, Artificial
  synthetic human C35/beta-catenin polytope
QLVFSKLENGGFPYEKDLIEAIRRASNGETLEKITNSRPPCVSYLDSGIHS

SEQ ID NO: 1235 - protein, 60 aa, Artificial
  synthetic human C35/beta-catenin polytope
SYLDSGIHSQLVFSKLENGGFPYEKDLIEAIRRASNGETLEKITNSRPPCVSYLDSGIHS

SEQ ID NO: 1236 - protein, 51 aa, Artificial
  synthetic human C35/tyrosinase polytope
QLVFSKLENGGFPYEKDLIEAIRRASNGETLEKITNSRPPCVMLLAVLYCL

SEQ ID NO: 1237 - protein, 60 aa, Artificial
  synthetic human C35/tyrosinase polytope
MLLAVLYCLQLVFSKLENGGFPYEKDLIEAIRRASNGETLEKITNSRPPCVMLLAVLYCL

SEQ ID NO: 1238 - protein, 51 aa, Artificial
  synthetic human C35/tyrosinase polytope
QLVFSKLENGGFPYEKDLIEAIRRASNGETLEKITNSRPPCVAFLPWHRLF

SEQ ID NO: 1239 - protein, 60 aa, Artificial
  synthetic human C35/tyrosinase polytope
AFLPWHRLFQLVFSKLENGGFPYEKDLIEAIRRASNGETLEKITNSRPPCVAFLPWHRLF

SEQ ID NO: 1240 - protein, 57 aa, Artificial
  synthetic human C35/tyrosinase polytope
QLVFSKLENGGFPYEKDLIEAIRRASNGETLEKITNSRPPCVQNILLSNAPLGPQFP

SEQ ID NO: 1241 - protein, 72 aa, Artificial
  synthetic human C35/tyrosinase polytope
QNILLSNAPLGPQFPQLVFSKLENGGFPYEKDLIEAIRRASNGETLEKITNSRPPCVQNILLSNAPLGPQFP

SEQ ID NO: 1242 - protein, 57 aa, Artificial
  synthetic human C35/tyrosinase polytope
QLVFSKLENGGFPYEKDLIEAIRRASNGETLEKITNSRPPCVDYSYLQDSDPDSFQD

SEQ ID NO: 1243 - protein, 72 aa, Artificial
  synthetic human C35/tyrosinase polytope
DYSYLQDSDPDSFQDQLVFSKLENGGFPYEKDLIEAIRRASNGETLEKITNSRPPCVDYSYLQDSDPDSFQD

SEQ ID NO: 1244 - protein, 51 aa, Artificial
  synthetic human C35/Melan-A polytope
QLVFSKLENGGFPYEKDLIEAIRRASNGETLEKITNSRPPCVILTVILGVL

SEQ ID NO: 1245 - protein, 60 aa, Artificial
  synthetic human C35/Melan-A polytope
ILTVILGVLQLVFSKLENGGFPYEKDLIEAIRRASNGETLEKITNSRPPCVILTVILGVL

SEQ ID NO: 1246 - protein, 51 aa, Artificial
  synthetic human C35/gp100 polytope
QLVFSKLENGGFPYEKDLIEAIRRASNGETLEKITNSRPPCVKTWGQYWQV

SEQ ID NO: 1247 - protein, 60 aa, Artificial
  synthetic human C35/gp100 polytope
KTWGQYWQVQLVFSKLENGGFPYEKDLIEAIRRASNGETLEKITNSRPPCVKTWGQYWQV

SEQ ID NO: 1248 - protein, 51 aa, Artificial
  synthetic human C35/gp100 polytope
QLVFSKLENGGFPYEKDLIEAIRRASNGETLEKITNSRPPCVITDQVPFSV

SEQ ID NO: 1249 - protein, 60 aa, Artificial
  synthetic human C35/gp100 polytope
ITDQVPFSVQLVFSKLENGGFPYEKDLIEAIRRASNGETLEKITNSRPPCVITDQVPFSV

SEQ ID NO: 1250 - protein, 51 aa, Artificial
  synthetic human C35/gp100 polytope
QLVFSKLENGGFPYEKDLIEAIRRASNGETLEKITNSRPPCVYLEPGPVTA

SEQ ID NO: 1251 - protein, 60 aa, Artificial
  synthetic human C35/gp100 polytope
YLEPGPVTAQLVFSKLENGGFPYEKDLIEAIRRASNGETLEKITNSRPPCVYLEPGPVTA

SEQ ID NO: 1252 - protein, 52 aa, Artificial
  synthetic human C35/gp100 polytope
QLVFSKLENGGFPYEKDLIEAIRRASNGETLEKITNSRPPCVLLDGTATLRL

SEQ ID NO: 1253 - protein, 62 aa, Artificial
  synthetic human C35/gp100 polytope
LLDGTATLRLQLVFSKLENGGFPYEKDLIEAIRRASNGETLEKITNSRPPCVLLDGTATLRL

SEQ ID NO: 1254 - protein, 52 aa, Artificial
  synthetic human C35/gp100 polytope
QLVFSKLENGGFPYEKDLIEAIRRASNGETLEKITNSRPPCVVLYRYGSFSV

SEQ ID NO: 1255 - protein, 62 aa, Artificial
  synthetic human C35/gp100 polytope
VLYRYGSFSVQLVFSKLENGGFPYEKDLIEAIRRASNGETLEKITNSRPPCVVLYRYGSFSV

SEQ ID NO: 1256 - protein, 51 aa, Artificial
  synthetic human C35/PRAME polytope
QLVFSKLENGGFPYEKDLIEAIRRASNGETLEKITNSRPPCVLYVDSLFFL

SEQ ID NO: 1257 - protein, 60 aa, Artificial
  synthetic human C35/PRAME polytope
LYVDSLFFLQLVFSKLENGGFPYEKDLIEAIRRASNGETLEKITNSRPPCVLYVDSLFFL

SEQ ID NO: 1258 - protein, 54 aa, Artificial
  synthetic human C35/MAGE-6 polytope
QLVFSKLENGGFPYEKDLIEAIRRASNGETLEKITNSRPPCVKISGGPRISYPL

SEQ ID NO: 1259 - protein, 66 aa, Artificial
  synthetic human C35/MAGE-6 polytope
KISGGPRISYPLQLVFSKLENGGFPYEKDLIEAIRRASNGETLEKITNSRPPCVKISGGPRISYPL

SEQ ID NO: 1260 - protein, 53 aa, Artificial
  synthetic human C35/NY-ESO-1 polytope
QLVFSKLENGGFPYEKDLIEAIRRASNGETLEKITNSRPPCVSLLMWITQCFL

SEQ ID NO: 1261 - protein, 64 aa, Artificial
  synthetic human C35/NY-ESO-1 polytope
SLLMWITQCFLQLVFSKLENGGFPYEKDLIEAIRRASNGETLEKITNSRPPCVSLLMWITQCFL

SEQ ID NO: 1262 - protein, 51 aa, Artificial
  synthetic human C35/NY-ESO-1 polytope
QLVFSKLENGGFPYEKDLIEAIRRASNGETLEKITNSRPPCVSLLMWITQC

SEQ ID NO: 1263 - protein, 60 aa, Artificial
  synthetic human C35/NY-ESO-1 polytope
SLLMWITQCQLVFSKLENGGFPYEKDLIEAIRRASNGETLEKITNSRPPCVSLLMWITQC

SEQ ID NO: 1264 - protein, 51 aa, Artificial
  synthetic human C35/NY-ESO-1 polytope
QLVFSKLENGGFPYEKDLIEAIRRASNGETLEKITNSRPPCVQLSLLMWIT

SEQ ID NO: 1265 - protein, 60 aa, Artificial
  synthetic human C35/NY-ESO-1 polytope
QLSLLMWITQLVFSKLENGGFPYEKDLIEAIRRASNGETLEKITNSRPPCVQLSLLMWIT

SEQ ID NO: 1266 - protein, 71 aa, Artificial
  synthetic human C35/NY-ESO-1/MAGE-3 polytope
SLLMWITQCFLPVFQLVFSKLENGGFPYEKDLIEAIRRASNGETLEKITNSRPPCVTSYVKVLHHMVKISG

SEQ ID NO: 1267 - protein, 58 aa, Artificial
  synthetic human C35/MAGE-1 polytope
FEIEINGQLVFSKLENGGFPYEKDLIEAIRRASNGETLEKITNSRPPCVEADPTGHSY

SEQ ID NO: 1268 - protein, 67 aa, Artificial
  synthetic human C35/MAGE-1 polytope
EADPTGHSYFEIEINGQLVFSKLENGGFPYEKDLIEAIRRASNGETLEKITNSRPPCVEADPTGHSY

SEQ ID NO: 1269 - protein, 58 aa, Artificial
  synthetic human C35/MAGE-1 polytope
FEIEINGQLVFSKLENGGFPYEKDLIEAIRRASNGETLEKITNSRPPCVSAYGEPRKL

SEQ ID NO: 1270 - protein, 67 aa, Artificial
  synthetic human C35/MAGE-1 polytope
SAYGEPRKLFEIEINGQLVFSKLENGGFPYEKDLIEAIRRASNGETLEKITNSRPPCVSAYGEPRKL

SEQ ID NO: 1271 - protein, 58 aa, Artificial
  synthetic human C35/MAGE-3 polytope
FEIEINGQLVFSKLENGGFPYEKDLIEAIRRASNGETLEKITNSRPPCVEVDPIGHLY

SEQ ID NO: 1272 - protein, 67 aa, Artificial
  synthetic human C35/MAGE-3 polytope
EVDPIGHLYFEIEINGQLVFSKLENGGFPYEKDLIEAIRRASNGETLEKITNSRPPCVEVDPIGHLY

SEQ ID NO: 1273 - protein, 58 aa, Artificial
  synthetic human C35/MAGE-3 polytope
FEIEINGQLVFSKLENGGFPYEKDLIEAIRRASNGETLEKITNSRPPCVFLWGPRALV

SEQ ID NO: 1274 - protein, 67 aa, Artificial
  synthetic human C35/MAGE-3 polytope
FLWGPRALVFEIEINGQLVFSKLENGGFPYEKDLIEAIRRASNGETLEKITNSRPPCVFLWGPRALV

SEQ ID NO: 1275 - protein, 59 aa, Artificial
  synthetic human C35/MAGE-3 polytope
FEIEINGQLVFSKLENGGFPYEKDLIEAIRRASNGETLEKITNSRPPCVMEVDPIGHLY

SEQ ID NO: 1276 - protein, 69 aa, Artificial
  synthetic human C35/MAGE-3 polytope
MEVDPIGHLYFEIEINGQLVFSKLENGGFPYEKDLIEAIRRASNGETLEKITNSRPPCVMEVDPIGHLY

SEQ ID NO: 1277 - protein, 58 aa, Artificial
  synthetic human C35/BAGE polytope
FEIEINGQLVFSKLENGGFPYEKDLIEAIRRASNGETLEKITNSRPPCVAARAVFLAL

SEQ ID NO: 1278 - protein, 67 aa, Artificial
  synthetic human C35/BAGE polytope
AARAVFLALFEIEINGQLVFSKLENGGFPYEKDLIEAIRRASNGETLEKITNSRPPCVAARAVFLAL

SEQ ID NO: 1279 - protein, 57 aa, Artificial
  synthetic human C35/GAGE-1,2 polytope
FEIEINGQLVFSKLENGGFPYEKDLIEAIRRASNGETLEKITNSRPPCVYRPRPRRY

SEQ ID NO: 1280 - protein, 65 aa, Artificial
  synthetic human C35/GAGE-1,2 polytope
YRPRPRRYFEIEINGQLVFSKLENGGFPYEKDLIEAIRRASNGETLEKITNSRPPCVYRPRPRRY

SEQ ID NO: 1281 - protein, 59 aa, Artificial
  synthetic human C35/RAGE polytope
FEIEINGQLVFSKLENGGFPYEKDLIEAIRRASNGETLEKITNSRPPCVSPSSNRIRNT

SEQ ID NO: 1282 - protein, 69 aa, Artificial
  synthetic human C35/RAGE polytope
SPSSNRIRNTFEIEINGQLVFSKLENGGFPYEKDLIEAIRRASNGETLEKITNSRPPCVSPSSNRIRNT

SEQ ID NO: 1283 - protein, 59 aa, Artificial
  synthetic human C35/CDK4 polytope
FEIEINGQLVFSKLENGGFPYEKDLIEAIRRASNGETLEKITNSRPPCVARDPHSGHFV

SEQ ID NO: 1284 - protein, 69 aa, Artificial
  synthetic human C35/CDK4 polytope
ARDPHSGHFVFEIEINGQLVFSKLENGGFPYEKDLIEAIRRASNGETLEKITNSRPPCVARDPHSGHFV

SEQ ID NO: 1285 - protein, 58 aa, Artificial
  synthetic human C35/beta-catenin polytope
FEIEINGQLVFSKLENGGFPYEKDLIEAIRRASNGETLEKITNSRPPCVSYLDSGIHS

SEQ ID NO: 1286 - protein, 67 aa, Artificial
  synthetic human C35/beta-catenin polytope
SYLDSGIHSFEIEINGQLVFSKLENGGFPYEKDLIEAIRRASNGETLEKITNSRPPCVSYLDSGIHS

SEQ ID NO: 1287 - protein, 58 aa, Artificial
  synthetic human C35/tyrosinase polytope
FEIEINGQLVFSKLENGGFPYEKDLIEAIRRASNGETLEKITNSRPPCVMLLAVLYCL

SEQ ID NO: 1288 - protein, 67 aa, Artificial
  synthetic human C35/tyrosinase polytope
MLLAVLYCLFEIEINGQLVFSKLENGGFPYEKDLIEAIRRASNGETLEKITNSRPPCVMLLAVLYCL

SEQ ID NO: 1289 - protein, 58 aa, Artificial
  synthetic human C35/tyrosinase polytope
FEIEINGQLVFSKLENGGFPYEKDLIEAIRRASNGETLEKITNSRPPCVAFLPWHRLF

SEQ ID NO: 1290 - protein, 67 aa, Artificial
  synthetic human C35/tyrosinase polytope
AFLPWHRLFFEIEINGQLVFSKLENGGFPYEKDLIEAIRRASNGETLEKITNSRPPCVAFLPWHRLF

SEQ ID NO: 1291 - protein, 64 aa, Artificial
  synthetic human C35/tyrosinase polytope
FEIEINGQLVFSKLENGGFPYEKDLIEAIRRASNGETLEKITNSRPPCVQNILLSNAPLGPQFP

SEQ ID NO: 1292 - protein, 79 aa, Artificial
  synthetic human C35/tyrosinase polytope
QNILLSNAPLGPQFPFEIEINGQLVFSKLENGGFPYEKDLIEAIRRASNGETLEKITNSRPPCVQNILLSNAPLGPQFP

SEQ ID NO: 1293 - protein, 64 aa, Artificial
  synthetic human C35/tyrosinase polytope
FEIEINGQLVFSKLENGGFPYEKDLIEAIRRASNGETLEKITNSRPPCVDYSYLQDSDPDSFQD

SEQ ID NO: 1294 - protein, 79 aa, Artificial
  synthetic human C35/tyrosinase polytope
DYSYLQDSDPDSFQDFEIEINGQLVFSKLENGGFPYEKDLIEAIRRASNGETLEKITNSRPPCVDYSYLQDSDPDSFQD

SEQ ID NO: 1295 - protein, 58 aa, Artificial
  synthetic human C35/Melan-A polytope
FEIEINGQLVFSKLENGGFPYEKDLIEAIRRASNGETLEKITNSRPPCVILTVILGVL

SEQ ID NO: 1296 - protein, 67 aa, Artificial
  synthetic human C35/Melan-A polytope
ILTVILGVLFEIEINGQLVFSKLENGGFPYEKDLIEAIRRASNGETLEKITNSRPPCVILTVILGVL

SEQ ID NO: 1297 - protein, 58 aa, Artificial
  synthetic human C35/gp100 polytope
FEIEINGQLVFSKLENGGFPYEKDLIEAIRRASNGETLEKITNSRPPCVKTWGQYWQV

SEQ ID NO: 1298 - protein, 67 aa, Artificial
  synthetic human C35/gp100 polytope
KTWGQYWQVFEIEINGQLVFSKLENGGFPYEKDLIEAIRRASNGETLEKITNSRPPCVKTWGQYWQV

SEQ ID NO: 1299 - protein, 58 aa, Artificial
  synthetic human C35/gp100 polytope
FEIEINGQLVFSKLENGGFPYEKDLIEAIRRASNGETLEKITNSRPPCVITDQVPFSV

SEQ ID NO: 1300 - protein, 67 aa, Artificial
  synthetic human C35/gp100 polytope
ITDQVPFSVFEIEINGQLVFSKLENGGFPYEKDLIEAIRRASNGETLEKITNSRPPCVITDQVPFSV

SEQ ID NO: 1301 - protein, 58 aa, Artificial
  synthetic human C35/gp100 polytope
FEIEINGQLVFSKLENGGFPYEKDLIEAIRRASNGETLEKITNSRPPCVYLEPGPVTA

SEQ ID NO: 1302 - protein, 67 aa, Artificial
  synthetic human C35/gp100 polytope
YLEPGPVTAFEIEINGQLVFSKLENGGFPYEKDLIEAIRRASNGETLEKITNSRPPCVYLEPGPVTA

SEQ ID NO: 1303 - protein, 59 aa, Artificial
  synthetic human C35/gp100 polytope
FEIEINGQLVFSKLENGGFPYEKDLIEAIRRASNGETLEKITNSRPPCVLLDGTATLRL

SEQ ID NO: 1304 - protein, 69 aa, Artificial
  synthetic human C35/gp100 polytope
LLDGTATLRLFEIEINGQLVFSKLENGGFPYEKDLIEAIRRASNGETLEKITNSRPPCVLLDGTATLRL

SEQ ID NO: 1305 - protein, 59 aa, Artificial
  synthetic human C35/gp100 polytope
FEIEINGQLVFSKLENGGFPYEKDLIEAIRRASNGETLEKITNSRPPCVVLYRYGSFSV

SEQ ID NO: 1306 - protein, 69 aa, Artificial
  synthetic human C35/gp100 polytope
VLYRYGSFSVFEIEINGQLVFSKLENGGFPYEKDLIEAIRRASNGETLEKITNSRPPCVVLYRYGSFSV

SEQ ID NO: 1307 - protein, 58 aa, Artificial
  synthetic human C35/PRAME polytope
FEIEINGQLVFSKLENGGFPYEKDLIEAIRRASNGETLEKITNSRPPCVLYVDSLFFL

SEQ ID NO: 1308 - protein, 67 aa, Artificial
  synthetic human C35/PRAME polytope
LYVDSLFFLFEIEINGQLVFSKLENGGFPYEKDLIEAIRRASNGETLEKITNSRPPCVLYVDSLFFL

SEQ ID NO: 1309 - protein, 61 aa, Artificial
  synthetic human C35/MAGE-6 polytope
FEIEINGQLVFSKLENGGFPYEKDLIEAIRRASNGETLEKITNSRPPCVKISGGPRISYPL

SEQ ID NO: 1310 - protein, 73 aa, Artificial
  synthetic human C35/MAGE-6 polytope
KISGGPRISYPLFEIEINGQLVFSKLENGGFPYEKDLIEAIRRASNGETLEKITNSRPPCVKISGGPRISYPL

SEQ ID NO: 1311 - protein, 62 aa, Artificial
  synthetic human C35/NY-ESO-1 polytope
FEIEINGQLVFSKLENGGFPYEKDLIEAIRRASNGETLEKITNSRPPCVILSLLMWITQCFL

SEQ ID NO: 1312 - protein, 71 aa, Artificial
  synthetic human C35/NY-ESO-1 polytope
SLLMWITQCFLFEIEINGQLVFSKLENGGFPYEKDLIEAIRRASNGETLEKITNSRPPCVSLLMWITQCFL

SEQ ID NO: 1313 - protein, 58 aa, Artificial
  synthetic human C35/NY-ESO-1 polytope
FEIEINGQLVFSKLENGGFPYEKDLIEAIRRASNGETLEKITNSRPPCVSLLMWITQC

SEQ ID NO: 1314 - protein, 67 aa, Artificial
  synthetic human C35/NY-ESO-1 polytope
SLLMWITQCFEIEINGQLVFSKLENGGFPYEKDLIEAIRRASNGETLEKITNSRPPCVSLLMWITQC

SEQ ID NO: 1315 - protein, 58 aa, Artificial
  synthetic human C35/NY-ESO-1 polytope
FEIEINGQLVFSKLENGGFPYEKDLIEAIRRASNGETLEKITNSRPPCVQLSLLMWIT

SEQ ID NO: 1316 - protein, 67 aa, Artificial
  synthetic human C35/NY-ESO-1 polytope
QLSLLMWITFEIEINGQLVFSKLENGGFPYEKDLIEAIRRASNGETLEKITNSRPPCVQLSLLMWIT

SEQ ID NO: 1317 - protein, 78 aa, Artificial
  synthetic human C35/NY-ESO-1/MAGE-3 polytope
SLLMWITQCFLPVFFEIEINGQLVFSKLENGGFPYEKDLIEAIRRASNGETLEKITNSRPPCVTSYVKVLHHMVKISG

SEQ ID NO: 1318 - protein, 64 aa, Artificial
  synthetic human C35/MAGE-1 polytope
LGGTGAFEIEINGQLVFSKLENGGFPYEKDLIEAIRRASNGETLEKITNSRPPCVEADPTGHSY

SEQ ID NO: 1319 - protein, 73 aa, Artificial
  synthetic human C35/MAGE-1 polytope
EADPTGHSYLGGTGAFEIEINGQLVFSKLENGGFPYEKDLIEAIRRASNGETLEKITNSRPPCVEADPTGHSY

SEQ ID NO: 1320 - protein, 64 aa, Artificial
  synthetic human C35/MAGE-1 polytope
LGGTGAFEIEINGQLVFSKLENGGFPYEKDLIEAIRRASNGETLEKITNSRPPCVSAYGEPRKL

SEQ ID NO: 1321 - protein, 73 aa, Artificial
  synthetic human C35/MAGE-1 polytope
SAYGEPRKLLGGTGAFEIEINGQLVFSKLENGGFPYEKDLIEAIRRASNGETLEKITNSRPPCVSAYGEPRKL

SEQ ID NO: 1322 - protein, 64 aa, Artificial
  synthetic human C35/MAGE-3 polytope
LGGTGAFEIEINGQLVFSKLENGGFPYEKDLIEAIRRASNGETLEKITNSRPPCVEVDPIGHLY

SEQ ID NO: 1323 - protein, 73 aa, Artificial
  synthetic human C35/MAGE-3 polytope
EVDPIGHLYLGGTGAFEIEINGQLVFSKLENGGFPYEKDLIEAIRRASNGETLEKITNSRPPCVEVDPIGHLY

SEQ ID NO: 1324 - protein, 64 aa, Artificial
  synthetic human C35/MAGE-3 polytope
LGGTGAFEIEINGQLVFSKLENGGFPYEKDLIEAIRRASNGETLEKITNSRPPCVFLWGPRALV

SEQ ID NO: 1325 - protein, 73 aa, Artificial
  synthetic human C35/MAGE-3 polytope
FLWGPRALVLGGTGAFEIEINGQLVFSKLENGGFPYEKDLIEAIRRASNGETLEKITNSRPPCVFLWGPRALV

SEQ ID NO: 1326 - protein, 65 aa, Artificial
  synthetic human C35/MAGE-3 polytope
LGGTGAFEIEINGQLVFSKLENGGFPYEKDLIEAIRRASNGETLEKITNSRPPCVMEVDPIGHLY

SEQ ID NO: 1327 - protein, 75 aa, Artificial
  synthetic human C35/MAGE-3 polytope
MEVDPIGHLYLGGTGAFEIEINGQLVFSKLENGGFPYEKDLIEAIRRASNGETLEKITNSRPPCVMEVDPIGHLY

SEQ ID NO: 1328 - protein, 64 aa, Artificial
  synthetic human C35/BAGE polytope
LGGTGAFEIEINGQLVFSKLENGGFPYEKDLIEAIRRASNGETLEKITNSRPPCVAARAVFLAL

SEQ ID NO: 1329 - protein, 73 aa, Artificial
  synthetic human C35/BAGE polytope
AARAVFLALLGGTGAFEIEINGQLVFSKLENGGFPYEKDLIEAIRRASNGETLEKITNSRPPCVAARAVFLAL

SEQ ID NO: 1330 - protein, 63 aa, Artificial
  synthetic human C35/GAGE-1,2 polytope
LGGTGAFEIEINGQLVFSKLENGGFPYEKDLIEAIRRASNGETLEKITNSRPPCVYRPRPRRY

SEQ ID NO: 1331 - protein, 71 aa, Artificial
  synthetic human C35/GAGE-1,2 polytope
YRPRPRRYLGGTGAFEIEINGQLVFSKLENGGFPYEKDLIEAIRRASNGETLEKITNSRPPCVYRPRPRRY

SEQ ID NO: 1332 - protein, 65 aa, Artificial
  synthetic human C35/RAGE polytope
LGGTGAFEIEINGQLVFSKLENGGFPYEKDLIEAIRRASNGETLEKITNSRPPCVSPSSNRIRNT

SEQ ID NO: 1333 - protein, 75 aa, Artificial
  synthetic human C35/RAGE polytope
SPSSNRIRNTLGGTGAFEIEINGQLVFSKLENGGFPYEKDLIEAIRRASNGETLEKITNSRPPCVSPSSNRIRNT

SEQ ID NO: 1334 - protein, 65 aa, Artificial
  synthetic human C35/CDK4 polytope
LGGTGAFEIEINGQLVFSKLENGGFPYEKDLIEAIRRASNGETLEKITNSRPPCVARDPHSGHFV

SEQ ID NO: 1335 - protein, 75 aa, Artificial
  synthetic human C35/CDK4 polytope
ARDPHSGHFVLGGTGAFEIEINGQLVFSKLENGGFPYEKDLIEAIRRASNGETLEKITNSRPPCVARDPHSGHFV

SEQ ID NO: 1336 - protein, 64 aa, Artificial
  synthetic human C35/beta-catenin polytope
LGGTGAFEIEINGQLVFSKLENGGFPYEKDLIEAIRRASNGETLEKITNSRPPCVSYLDSGIHS

SEQ ID NO: 1337 - protein, 73 aa, Artificial
  synthetic human C35/beta-catenin polytope
SYLDSGIHSLGGTGAFEIEINGQLVFSKLENGGFPYEKDLIEAIRRASNGETLEKITNSRPPCVSYLDSGIHS

SEQ ID NO: 1338 - protein, 64 aa, Artificial
  synthetic human C35/tyrosinase polytope
LGGTGAFEIEINGQLVFSKLENGGFPYEKDLIEAIRRASNGETLEKITNSRPPCVMLLAVLYCL

SEQ ID NO: 1339 - protein, 73 aa, Artificial
  synthetic human C35/tyrosinase polytope
MLLAVLYCLLGGTGAFEIEINGQLVFSKLENGGFPYEKDLIEAIRRASNGETLEKITNSRPPCVMLLAVLYCL

SEQ ID NO: 1340 - protein, 64 aa, Artificial
  synthetic human C35/tyrosinase polytope
LGGTGAFEIEINGQLVFSKLENGGFPYEKDLIEAIRRASNGETLEKITNSRPPCVAFLPWHRLF

SEQ ID NO: 1341 - protein, 73 aa, Artificial
  synthetic human C35/tyrosinase polytope
AFLPWHRLFLGGTGAFEIEINGQLVFSKLENGGFPYEKDLIEAIRRASNGETLEKITNSRPPCVAFLPWHRLF

SEQ ID NO: 1342 - protein, 70 aa, Artificial
  synthetic human C35/tyrosinase polytope
LGGTGAFEIEINGQLVFSKLENGGFPYEKDLIEAIRRASNGETLEKITNSRPPCVQNILLSNAPLGPQFP

SEQ ID NO: 1343 - protein, 85 aa, Artificial
  synthetic human C35/tyrosinase polytope
QNILLSNAPLGPQFPLGGTGAFEIEINGQLVFSKLENGGFPYEKDLIEAIRRASNGETLEKITNSRPPCVQNILLSNAPLGPQFP

SEQ ID NO: 1344 - protein, 70 aa, Artificial
  synthetic human C35/tyrosinase polytope
LGGTGAFEIEINGQLVFSKLENGGFPYEKDLIEAIRRASNGETLEKITNSRPPCVDYSYLQDSDPDSFQD

SEQ ID NO: 1345 - protein, 85 aa, Artificial
  synthetic human C35/tyrosinase polytope
DYSYLQDSDPDSFQDLGGTGAFEIEINGQLVFSKLENGGFPYEKDLIEAIRRASNGETLEKITNSRPPCVDYSYLQDSDPDSFQD

SEQ ID NO: 1346 - protein, 64 aa, Artificial
  synthetic human C35/Melan-A polytope
LGGTGAFEIEINGQLVFSKLENGGFPYEKDLIEAIRRASNGETLEKITNSRPPCVILTVILGVL

SEQ ID NO: 1347 - protein, 73 aa, Artificial
  synthetic human C35/Melan-A polytope
ILTVILGVLLGGTGAFEIEINGQLVFSKLENGGFPYEKDLIEAIRRASNGETLEKITNSRPPCVILTVILGVL

SEQ ID NO: 1348 - protein, 64 aa, Artificial
  synthetic human C35/gp100 polytope
LGGTGAFEIEINGQLVFSKLENGGFPYEKDLIEAIRRASNGETLEKITNSRPPCVKTWGQYWQV

SEQ ID NO: 1349 - protein, 73 aa, Artificial
  synthetic human C35/gp100 polytope
KTWGQYWQVLGGTGAFEIEINGQLVFSKLENGGFPYEKDLIEAIRRASNGETLEKITNSRPPCVKTWGQYWQV

SEQ ID NO: 1350 - protein, 64 aa, Artificial
  synthetic human C35/gp100 polytope
LGGTGAFEIEINGQLVFSKLENGGFPYEKDLIEAIRRASNGETLEKITNSRPPCVITDQVPFSV

SEQ ID NO: 1351 - protein, 73 aa, Artificial
  synthetic human C35/gp100 polytope
ITDQVPFSVLGGTGAFEIEINGQLVFSKLENGGFPYEKDLIEAIRRASNGETLEKITNSRPPCVITDQVPFSV

SEQ ID NO: 1352 - protein, 64 aa, Artificial
  synthetic human C35/gp100 polytope
LGGTGAFEIEINGQLVFSKLENGGFPYEKDLIEAIRRASNGETLEKITNSRPPCVYLEPGPVTA

SEQ ID NO: 1353 - protein, 73 aa, Artificial
  synthetic human C35/gp100 polytope
YLEPGPVTALGGTGAFEIEINGQLVFSKLENGGFPYEKDLIEAIRRASNGETLEKITNSRPPCVYLEPGPVTA

SEQ ID NO: 1354 - protein, 65 aa, Artificial
  synthetic human C35/gp100 polytope
LGGTGAFEIEINGQLVFSKLENGGFPYEKDLIEAIRRASNGETLEKITNSRPPCVLLDGTATLRL

SEQ ID NO: 1355 - protein, 75 aa, Artificial
  synthetic human C35/gp100 polytope
LLDGTATLRLLGGTGAFEIEINGQLVFSKLENGGFPYEKDLIEAIRRASNGETLEKITNSRPPCVLLDGTATLRL

SEQ ID NO: 1356 - protein, 65 aa, Artificial
  synthetic human C35/gp100 polytope
LGGTGAFEIEINGQLVFSKLENGGFPYEKDLIEAIRRASNGETLEKITNSRPPCVVLYRYGSFSV

SEQ ID NO: 1357 - protein, 75 aa, Artificial
  synthetic human C35/gp100 polytope
VLYRYGSFSVLGGTGAFEIEINGQLVFSKLENGGFPYEKDLIEAIRRASNGETLEKITNSRPPCVVLYRYGSFSV

SEQ ID NO: 1358 - protein, 64 aa, Artificial
  synthetic human C35/PRAME polytope
LGGTGAFEIEINGQLVFSKLENGGFPYEKDLIEAIRRASNGETLEKITNSRPPCVLYVDSLFFL

SEQ ID NO: 1359 - protein, 73 aa, Artificial
  synthetic human C35/PRAME polytope
LYVDSLFFLLGGTGAFEIEINGQLVFSKLENGGFPYEKDLIEAIRRASNGETLEKITNSRPPCVLYVDSLFFL

SEQ ID NO: 1360 - protein, 67 aa, Artificial
  synthetic human C35/MAGE-6 polytope
LGGTGAFEIEINGQLVFSKLENGGFPYEKDLIEAIRRASNGETLEKITNSRPPCVKISGGPRISYPL

SEQ ID NO: 1361 - protein, 79 aa, Artificial
  synthetic human C35/MAGE-6 polytope
KISGGPRISYPLLGGTGAFEIEINGQLVFSKLENGGFPYEKDLIEAIRRASNGETLEKITNSRPPCVKISGGPRISYPL

SEQ ID NO: 1362 - protein, 66 aa, Artificial
  synthetic human C35/NY-ESO-1 polytope
LGGTGAFEIEINGQLVFSKLENGGFPYEKDLIEAIRRASNGETLEKITNSRPPCVSLLMWITQCFL

SEQ ID NO: 1363 - protein, 77 aa, Artificial
  synthetic human C35/NY-ESO-1 polytope
SLLMWITQCFLLGGTGAFEIEINGQLVFSKLENGGFPYEKDLIEAIRRASNGETLEKITNSRPPCVSLLMWITQCFL

SEQ ID NO: 1364 - protein, 64 aa, Artificial
  synthetic human C35/NY-ESO-1 polytope
LGGTGAFEIEINGQLVFSKLENGGFPYEKDLIEAIRRASNGETLEKITNSRPPCVSLLMWITQC

SEQ ID NO: 1365 - protein, 73 aa, Artificial
  synthetic human C35/NY-ESO-1 polytope
SLLMWITQCLGGTGAFEIEINGQLVFSKLENGGFPYEKDLIEAIRRASNGETLEKITNSRPPCVSLLMWITQC

SEQ ID NO: 1366 - protein, 64 aa, Artificial
  synthetic human C35/NY-ESO-1 polytope
LGGTGAFEIEINGQLVFSKLENGGFPYEKDLIEAIRRASNGETLEKITNSRPPCVQLSLLMWIT

SEQ ID NO: 1367 - protein, 73 aa, Artificial
  synthetic human C35/NY-ESO-1 polytope
QLSLLMWITLGGTGAFEIEINGQLVFSKLENGGFPYEKDLIEAIRRASNGETLEKITNSRPPCVQLSLLMWIT

SEQ ID NO: 1368 - protein, 84 aa, Artificial
  synthetic human C35/NY-ESO-1/MAGE-3 polytope
SLLMWITQCFLPVFLGGTGAFEIEINGQLVFSKLENGGFPYEKDLIEAIRRASNGETLEKITNSRPPCVTSYVKVLHHMVKISG

SEQ ID NO: 1369 - protein, 24 aa, Artificial
  synthetic human C35/MAGE-1 polytope
GETLEKITNSRPPCVEADPTGHSY

SEQ ID NO: 1370 - protein, 33 aa, Artificial
  synthetic human C35/MAGE-1 polytope
EADPTGHSYGETLEKITNSRPPCVEADPTGHSY

SEQ ID NO: 1371 - protein, 24 aa, Artificial
  synthetic human C35/MAGE-1 polytope
GETLEKITNSRPPCVSAYGEPRKL

SEQ ID NO: 1372 - protein, 33 aa, Artificial
  synthetic human C35/MAGE-1 polytope
SAYGEPRKLGETLEKITNSRPPCVSAYGEPRKL

SEQ ID NO: 1373 - protein, 24 aa, Artificial
  synthetic human C35/MAGE-3 polytope
GETLEKITNSRPPCVEVDPIGHLY

SEQ ID NO: 1374 - protein, 33 aa, Artificial
  synthetic human C35/MAGE-3 polytope
EVDPIGHLYGETLEKITNSRPPCVEVDPIGHLY

SEQ ID NO: 1375 - protein, 24 aa, Artificial
  synthetic human C35/MAGE-3 polytope
GETLEKITNSRPPCVFLWGPRALV

SEQ ID NO: 1376 - protein, 33 aa, Artificial
  synthetic human C35/MAGE-3 polytope
FLWGPRALVGETLEKITNSRPPCVFLWGPRALV

SEQ ID NO: 1377 - protein, 25 aa, Artificial
  synthetic human C35/MAGE-3 polytope
GETLEKITNSRPPCVMEVDPIGHLY

SEQ ID NO: 1378 - protein, 35 aa, Artificial
  synthetic human C35/MAGE-3 polytope
MEVDPIGHLYGETLEKITNSRPPCVMEVDPIGHLY

SEQ ID NO: 1379 - protein, 24 aa, Artificial
  synthetic human C35/BAGE polytope
GETLEKITNSRPPCVAARAVFLAL

SEQ ID NO: 1380 - protein, 33 aa, Artificial
  synthetic human C35/BAGE polytope
AARAVFLALGETLEKITNSRPPCVAARAVFLAL

SEQ ID NO: 1381 - protein, 23 aa, Artificial
  synthetic human C35/GAGE-1,2 polytope
GETLEKITNSRPPCVYRPRPRRY

SEQ ID NO: 1382 - protein, 31 aa, Artificial
  synthetic human C35/GAGE-1,2 polytope
YRPRPRRYGETLEKITNSRPPCVYRPRPRRY

SEQ ID NO: 1383 - protein, 25 aa, Artificial
  synthetic human C35/RAGE polytope
GETLEKITNSRPPCVSPSSNRIRNT

SEQ ID NO: 1384 - protein, 35 aa, Artificial
  synthetic human C35/RAGE polytope
SPSSNRIRNTGETLEKITNSRPPCVSPSSNRIRNT

SEQ ID NO: 1385 - protein, 25 aa, Artificial
  synthetic human C35/CDK4 polytope
GETLEKITNSRPPCVARDPHSGHFV

SEQ ID NO: 1386 - protein, 35 aa, Artificial
  synthetic human C35/CDK4 polytope
ARDPHSGHFVGETLEKITNSRPPCVARDPHSGHFV

SEQ ID NO: 1387 - protein, 24 aa, Artificial
  synthetic human C35/beta-catenin polytope
GETLEKITNSRPPCVSYLDSGIHS

SEQ ID NO: 1388 - protein, 33 aa, Artificial
  synthetic human C35/beta-catenin polytope
SYLDSGIHSGETLEKITNSRPPCVSYLDSGIHS

SEQ ID NO: 1389 - protein, 24 aa, Artificial
  synthetic human C35/tyrosinase polytope
GETLEKITNSRPPCVMLLAVLYCL

SEQ ID NO: 1390 - protein, 33 aa, Artificial
  synthetic human C35/tyrosinase polytope
MLLAVLYCLGETLEKITNSRPPCVMLLAVLYCL

SEQ ID NO: 1391 - protein, 24 aa, Artificial
  synthetic human C35/tyrosinase polytope
GETLEKITNSRPPCVAFLPWHRLF

SEQ ID NO: 1392 - protein, 33 aa, Artificial
  synthetic human C35/tyrosinase polytope
AFLPWHRLFGETLEKITNSRPPCVAFLPWHRLF

SEQ ID NO: 1393 - protein, 30 aa, Artificial
  synthetic human C35/tyrosinase polytope
GETLEKITNSRPPCVQNILLSNAPLGPQFP

SEQ ID NO: 1394 - protein, 45 aa, Artificial
  synthetic human C35/tyrosinase polytope
QNILLSNAPLGPQFPGETLEKITNSRPPCVQNILLSNAPLGPQFP

SEQ ID NO: 1395 - protein, 30 aa, Artificial
  synthetic human C35/tyrosinase polytope
GETLEKITNSRPPCVDYSYLQDSDPDSFQD

SEQ ID NO: 1396 - protein, 45 aa, Artificial
  synthetic human C35/tyrosinase polytope
DYSYLQDSDPDSFQDGETLEKITNSRPPCVDYSYLQDSDPDSFQD

SEQ ID NO: 1397 - protein, 24 aa, Artificial
  synthetic human C35/Melan-A polytope
GETLEKITNSRPPCVILTVILGVL

SEQ ID NO: 1398 - protein, 33 aa, Artificial
  synthetic human C35/Melan-A polytope
ILTVILGVLGETLEKITNSRPPCVILTVILGVL

SEQ ID NO: 1399 - protein, 24 aa, Artificial
  synthetic human C35/gp100 polytope
GETLEKITNSRPPCVKTWGQYWQV

SEQ ID NO: 1400 - protein, 33 aa, Artificial
  synthetic human C35/gp100 polytope
KTWGQYWQVGETLEKITNSRPPCVKTWGQYWQV

SEQ ID NO: 1401 - protein, 18 aa, Artificial
  synthetic human C35/gp100 polytope
SVAPPPEEVITDQVPFSV

SEQ ID NO: 1402 - protein, 27 aa, Artificial
  synthetic human C35/gp100 polytope
ITDQVPFSVSVAPPPEEVITDQVPFSV

SEQ ID NO: 1403 - protein, 18 aa, Artificial
  synthetic human C35/gp100 polytope
SVAPPPEEVYLEPGPVTA

SEQ ID NO: 1404 - protein, 27 aa, Artificial
  synthetic human C35/gp100 polytope
YLEPGPVTASVAPPPEEVYLEPGPVTA

SEQ ID NO: 1405 - protein, 25 aa, Artificial
  synthetic human C35/gp100 polytope
GETLEKITNSRPPCVLLDGTATLRL

SEQ ID NO: 1406 - protein, 35 aa, Artificial
  synthetic human C35/gp100 polytope
LLDGTATLRLGETLEKITNSRPPCVLLDGTATLRL

SEQ ID NO: 1407 - protein, 25 aa, Artificial
  synthetic human C35/gp100 polytope
GETLEKITNSRPPCVVLYRYGSFSV

SEQ ID NO: 1408 - protein, 35 aa, Artificial
  synthetic human C35/gp100 polytope
VLYRYGSFSVGETLEKITNSRPPCVVLYRYGSFSV

SEQ ID NO: 1409 - protein, 24 aa, Artificial
  synthetic human C35/PRAME polytope
GETLEKITNSRPPCVLYVDSLFFL

SEQ ID NO: 1410 - protein, 33 aa, Artificial
  synthetic human C35/PRAME polytope
LYVDSLFFLGETLEKITNSRPPCVLYVDSLFFL

SEQ ID NO: 1411 - protein, 27 aa, Artificial
  synthetic human C35/MAGE-6 polytope
GETLEKITNSRPPCVKISGGPRISYPL

SEQ ID NO: 1412 - protein, 39 aa, Artificial
  synthetic human C35/MAGE-6 polytope
KISGGPRISYPLGETLEKITNSRPPCVKISGGPRISYPL

SEQ ID NO: 1413 - protein, 26 aa, Artificial
  synthetic human C35/NY-ESO-1 polytope
GETLEKITNSRPPCVSLLMWITQCFL

SEQ ID NO: 1414 - protein, 37 aa, Artificial
  synthetic human C35/NY-ESO-1 polytope
SLLMWITQCFLGETLEKITNSRPPCVSLLMWITQCFL

SEQ ID NO: 1415 - protein, 24 aa, Artificial
  synthetic human C35/NY-ESO-1 polytope
GETLEKITNSRPPCVSLLMWITQC

SEQ ID NO: 1416 - protein, 33 aa, Artificial
  synthetic human C35/NY-ESO-1 polytope
SLLMWITQCGETLEKITNSRPPCVSLLMWITQC

SEQ ID NO: 1417 - protein, 24 aa, Artificial
  synthetic human C35/NY-ESO-1 polytope
GETLEKITNSRPPCVQLSLLMWIT

SEQ ID NO: 1418 - protein, 33 aa, Artificial
  synthetic human C35/NY-ESO-1 polytope
QLSLLMWITGETLEKITNSRPPCVQLSLLMWIT

SEQ ID NO: 1419 - protein, 44 aa, Artificial
  synthetic human C35/NY-ESO-1/MAGE-3 polytope
SLLMWITQCFLPVFGETLEKITNSRPPCVTSYVKVLHHMVKISG

SEQ ID NO: 1420 - protein, 22 aa, Artificial
  synthetic human C35/MAGE-1 polytope
ETLEKITNSRPPCVADPTGHSY

SEQ ID NO: 1421 - protein, 32 aa, Artificial
  synthetic human C35/MAGE-1 polytope
EADPTGHSYETLEKITNSRPPCVEADPTGHSY

SEQ ID NO: 1422 - protein, 23 aa, Artificial
  synthetic human C35/MAGE-1 polytope
ETLEKITNSRPPCVSAYGEPRKL

SEQ ID NO: 1423 - protein, 32 aa, Artificial
  synthetic human C35/MAGE-1 polytope
SAYGEPRKLETLEKITNSRPPCVSAYGEPRKL

SEQ ID NO: 1424 - protein, 23 aa, Artificial
  synthetic human C35/MAGE-3 polytope
ETLEKITNSRPPCVEVDPIGHLY

SEQ ID NO: 1425 - protein, 32 aa, Artificial
  synthetic human C35/MAGE-3 polytope
EVDPIGHLYETLEKITNSRPPCVEVDPIGHLY

SEQ ID NO: 1426 - protein, 23 aa, Artificial
  synthetic human C35/MAGE-3 polytope
ETLEKITNSRPPCVFLWGPRALV

SEQ ID NO: 1427 - protein, 32 aa, Artificial
  synthetic human C35/MAGE-3 polytope
FLWGPRALVETLEKITNSRPPCVFLWGPRALV

SEQ ID NO: 1428 - protein, 24 aa, Artificial
  synthetic human C35/MAGE-3 polytope
ETLEKITNSRPPCVMEVDPIGHLY

SEQ ID NO: 1429 - protein, 34 aa, Artificial
  synthetic human C35/MAGE-3 polytope
MEVDPIGHLYETLEKITNSRPPCVMEVDPIGHLY

SEQ ID NO: 1430 - protein, 23 aa, Artificial
  synthetic human C35/BAGE polytope
ETLEKITNSRPPCVAARAVFLAL

SEQ ID NO: 1431 - protein, 32 aa, Artificial
  synthetic human C35/BAGE polytope
AARAVFLALETLEKITNSRPPCVAARAVFLAL

SEQ ID NO: 1432 - protein, 22 aa, Artificial
  synthetic human C35/GAGE-1,2 polytope
ETLEKITNSRPPCVYRPRPRRY

SEQ ID NO: 1433 - protein, 30 aa, Artificial
  synthetic human C35/GAGE-1,2 polytope
YRPRPRRYETLEKITNSRPPCVYRPRPRRY

SEQ ID NO: 1434 - protein, 24 aa, Artificial
  synthetic human C35/RAGE polytope
ETLEKITNSRPPCVSPSSNRIRNT

SEQ ID NO: 1435 - protein, 34 aa, Artificial
  synthetic human C35/RAGE polytope
SPSSNRIRNTETLEKITNSRPPCVSPSSNRIRNT

SEQ ID NO: 1436 - protein, 24 aa, Artificial
  synthetic human C35/CDK4 polytope
ETLEKITNSRPPCVARDPHSGHFV

SEQ ID NO: 1437 - protein, 34 aa, Artificial
  synthetic human C35/CDK4 polytope
ARDPHSGHFVETLEKITNSRPPCVARDPHSGHFV

SEQ ID NO: 1438 - protein, 23 aa, Artificial
  synthetic human C35/beta-catenin polytope
ETLEKITNSRPPCVSYLDSGIHS

SEQ ID NO: 1439 - protein, 32 aa, Artificial
  synthetic human C35/beta-catenin polytope
SYLDSGIHSETLEKITNSRPPCVSYLDSGIHS

SEQ ID NO: 1440 - protein, 23 aa, Artificial
  synthetic human C35/tyrosinase polytope
ETLEKITNSRPPCVMLLAVLYCL

SEQ ID NO: 1441 - protein, 32 aa, Artificial
  synthetic human C35/tyrosinase polytope
MLLAVLYCLETLEKITNSRPPCVMLLAVLYCL

SEQ ID NO: 1442 - protein, 23 aa, Artificial
  synthetic human C35/tyrosinase polytope
ETLEKITNSRPPCVAFLPWHRLF

SEQ ID NO: 1443 - protein, 32 aa, Artificial
  synthetic human C35/tyrosinase polytope
AFLPWHRLFETLEKITNSRPPCVAFLPWHRLF

SEQ ID NO: 1444 - protein, 29 aa, Artificial
  synthetic human C35/tyrosinase polytope
ETLEKITNSRPPCVQNILLSNAPLGPQFP

SEQ ID NO: 1445 - protein, 44 aa, Artificial
  synthetic human C35/tyrosinase polytope
QNILLSNAPLGPQFPETLEKITNSRPPCVQNILLSNAPLGPQFP

SEQ ID NO: 1446 - protein, 29 aa, Artificial
  synthetic human C35/tyrosinase polytope
ETLEKITNSRPPCVDYSYLQDSDPDSFQD

SEQ ID NO: 1447 - protein, 44 aa, Artificial
  synthetic human C35/tyrosinase polytope
DYSYLQDSDPDSFQDETLEKITNSRPPCVDYSYLQDSDPDSFQD

SEQ ID NO: 1448 - protein, 23 aa, Artificial
  synthetic human C35/Melan-A polytope
ETLEKITNSRPPCVILTVILGVL

SEQ ID NO: 1449 - protein, 32 aa, Artificial
  synthetic human C35/Melan-A polytope
ILTVILGVLETLEKITNSRPPCVILTVILGVL

SEQ ID NO: 1450 - protein, 23 aa, Artificial
  synthetic human C35/gp100 polytope
ETLEKITNSRPPCVKTWGQYWQV

SEQ ID NO: 1451 - protein, 32 aa, Artificial
  synthetic human C35/gp100 polytope
KTWGQYWQVETLEKITNSRPPCVKTWGQYWQV

SEQ ID NO: 1452 - protein, 23 aa, Artificial
  synthetic human C35/gp100 polytope
ETLEKITNSRPPCVITDQVPFSV

SEQ ID NO: 1453 - protein, 32 aa, Artificial
  synthetic human C35/gp100 polytope
ITDQVPFSVETLEKITNSRPPCVITDQVPFSV

SEQ ID NO: 1454 - protein, 23 aa, Artificial
  synthetic human C35/gp100 polytope
ETLEKITNSRPPCVYLEPGPVTA

SEQ ID NO: 1455 - protein, 32 aa, Artificial
  synthetic human C35/gp100 polytope
YLEPGPVTAETLEKITNSRPPCVYLEPGPVTA

SEQ ID NO: 1456 - protein, 24 aa, Artificial
  synthetic human C35/gp100 polytope
ETLEKITNSRPPCVLLDGTATLRL

SEQ ID NO: 1457 - protein, 34 aa, Artificial
  synthetic human C35/gp100 polytope
LLDGTATLRLETLEKITNSRPPCVLLDGTATLRL

SEQ ID NO: 1458 - protein, 24 aa, Artificial
  synthetic human C35/gp100 polytope
ETLEKITNSRPPCVVLYRYGSFSV

SEQ ID NO: 1459 - protein, 34 aa, Artificial
  synthetic human C35/gp100 polytope
VLYRYGSFSVETLEKITNSRPPCVVLYRYGSFSV

SEQ ID NO: 1460 - protein, 23 aa, Artificial
  synthetic human C35/PRAME polytope
ETLEKITNSRPPCVLYVDSLFFL

SEQ ID NO: 1461 - protein, 32 aa, Artificial
  synthetic human C35/PRAME polytope
LYVDSLFFLETLEKITNSRPPCVLYVDSLFFL

SEQ ID NO: 1462 - protein, 26 aa, Artificial
  synthetic human C35/MAGE-6 polytope
ETLEKITNSRPPCVKISGGPRISYPL

SEQ ID NO: 1463 - protein, 38 aa, Artificial
  synthetic human C35/MAGE-6 polytope
KISGGPRISYPLETLEKITNSRPPCVKISGGPRISYPL

SEQ ID NO: 1464 - protein, 25 aa, Artificial
  synthetic human C35/NY-ESO-1 polytope
ETLEKITNSRPPCVSLLMWITQCFL

SEQ ID NO: 1465 - protein, 36 aa, Artificial
  synthetic human C35/NY-ESO-1 polytope
SLLMWITQCFLETLEKITNSRPPCVSLLMWITQCFL

SEQ ID NO: 1466 - protein, 23 aa, Artificial
  synthetic human C35/NY-ESO-1 polytope
ETLEKITNSRPPCVSLLMWITQC

SEQ ID NO: 1467 - protein, 32 aa, Artificial
  synthetic human C35/NY-ESO-1 polytope
SLLMWITQCETLEKITNSRPPCVSLLMWITQC

SEQ ID NO: 1468 - protein, 23 aa, Artificial
  synthetic human C35/NY-ESO-1 polytope
ETLEKITNSRPPCVQLSLLMWIT

SEQ ID NO: 1469 - protein, 32 aa, Artificial
  synthetic human C35/NY-ESO-1 polytope
QLSLLMWITETLEKITNSRPPCVQLSLLMWIT

SEQ ID NO: 1470 - protein, 43 aa, Artificial
  synthetic human C35/NY-ESO-1/MAGE-3 polytope
SLLMWITQCFLPVFETLEKITNSRPPCVTSYVKVLHHMVKISG

SEQ ID NO: 1471 - protein, 18 aa, Artificial
  synthetic human C35/MAGE-1 polytope
KLENGGFPVEADPTGHSY

SEQ ID NO: 1472 - protein, 27 aa, Artificial
  synthetic human C35/MAGE-1 polytope
EADPTGHSYKLENGGFPVEADPTGHSY

SEQ ID NO: 1473 - protein, 18 aa, Artificial
  synthetic human C35/MAGE-1 polytope
KLENGGFPVSAYGEPRKL

SEQ ID NO: 1474 - protein, 27 aa, Artificial
  synthetic human C35/MAGE-1 polytope
SAYGEPRKLKLENGGFPVSAYGEPRKL

SEQ ID NO: 1475 - protein, 18 aa, Artificial
  synthetic human C35/MAGE-3 polytope
KLENGGFPVEVDPIGHLY

SEQ ID NO: 1476 - protein, 27 aa, Artificial
  synthetic human C35/MAGE-3 polytope
EVDPIGHLYKLENGGFPVEVDPIGHLY

SEQ ID NO: 1477 - protein, 18 aa, Artificial
  synthetic human C35/MAGE-3 polytope
KLENGGFPVFLWGPRALV

SEQ ID NO: 1478 - protein, 27 aa, Artificial
  synthetic human C35/MAGE-3 polytope
FLWGPRALVKLENGGFPVFLWGPRALV

SEQ ID NO: 1479 - protein, 19 aa, Artificial
  synthetic human C35/MAGE-3 polytope
KLENGGFPVMEVDPIGHLY

SEQ ID NO: 1480 - protein, 29 aa, Artificial
  synthetic human C35/MAGE-3 polytope
MEVDPIGHLYKLENGGFPVMEVDPIGHLY

SEQ ID NO: 1481 - protein, 18 aa, Artificial
  synthetic human C35/BAGE polytope
KLENGGFPVAARAVFLAL

SEQ ID NO: 1482 - protein, 27 aa, Artificial
  synthetic human C35/BAGE polytope
AARAVFLALKLENGGFPVAARAVFLAL

SEQ ID NO: 1483 - protein, 17 aa, Artificial
  synthetic human C35/GAGE-1,2 polytope
KLENGGFPVYRPRPRRY

SEQ ID NO: 1484 - protein, 25 aa, Artificial
  synthetic human C35/GAGE-1,2 polytope
YRPRPRRYKLENGGFPVYRPRPRRY

SEQ ID NO: 1485 - protein, 19 aa, Artificial
  synthetic human C35/RAGE polytope
KLENGGFPVSPSSNRIRNT

SEQ ID NO: 1486 - protein, 29 aa, Artificial
  synthetic human C35/RAGE polytope
SPSSNRIRNTKLENGGFPVSPSSNRIRNT

SEQ ID NO: 1487 - protein, 19 aa, Artificial
  synthetic human C35/CDK4 polytope
KLENGGFPVARDPHSGHFV

SEQ ID NO: 1488 - protein, 29 aa, Artificial
  synthetic human C35/CDK4 polytope
ARDPHSGHFVKLENGGFPVARDPHSGHFV

SEQ ID NO: 1489 - protein, 18 aa, Artificial
  synthetic human C35/beta-catenin polytope
KLENGGFPVSYLDSGIHS

SEQ ID NO: 1490 - protein, 27 aa, Artificial
  synthetic human C35/beta-catenin polytope
SYLDSGIHSKLENGGFPVSYLDSGIHS

SEQ ID NO: 1491 - protein, 19 aa, Artificial
  synthetic human C35/RAGE polytope
GVRIVVEYASPSSNRIRNT

SEQ ID NO: 1492 - protein, 29 aa, Artificial
  synthetic human C35/RAGE polytope
SPSSNRIRNTGVRIVVEYASPSSNRIRNT

SEQ ID NO: 1493 - protein, 19 aa, Artificial
  synthetic human C35/CDK4 polytope
GVRIVVEYAARDPHSGHFV

SEQ ID NO: 1494 - protein, 29 aa, Artificial
  synthetic human C35/CDK4 polytope
ARDPHSGHFVGVRIVVEYAARDPHSGHFV

SEQ ID NO: 1495 - protein, 18 aa, Artificial
  synthetic human C35/beta-catenin polytope
GVRIVVEYASYLDSGIHS

SEQ ID NO: 1496 - protein, 27 aa, Artificial
  synthetic human C35/beta-catenin polytope
SYLDSGIHSGVRIVVEYASYLDSGIHS

SEQ ID NO: 1497 - protein, 18 aa, Artificial
  synthetic human C35/tyrosinase polytope
GVRIVVEYAMLLAVLYCL

SEQ ID NO: 1498 - protein, 27 aa, Artificial
  synthetic human C35/tyrosinase polytope
MLLAVLYCLGVRIVVEYAMLLAVLYCL

SEQ ID NO: 1499 - protein, 18 aa, Artificial
  synthetic human C35/tyrosinase polytope
GVRIVVEYAAFLPWHRLF

SEQ ID NO: 1500 - protein, 18 aa, Artificial
  synthetic human C35/tyrosinase polytope
KLENGGFPVMLLAVLYCL

SEQ ID NO: 1501 - protein, 27 aa, Artificial
  synthetic human C35/tyrosinase polytope
MLLAVLYCLKLENGGFPVMLLAVLYCL

SEQ ID NO: 1502 - protein, 18 aa, Artificial
  synthetic human C35/tyrosinase polytope
KLENGGFPVAFLPWHRLF

SEQ ID NO: 1503 - protein, 27 aa, Artificial
  synthetic human C35/tyrosinase polytope
AFLPWHRLFKLENGGFPVAFLPWHRLF

SEQ ID NO: 1504 - protein, 24 aa, Artificial
  synthetic human C35/tyrosinase polytope
KLENGGFPVQNILLSNAPLGPQFP

SEQ ID NO: 1505 - protein, 39 aa, Artificial
  synthetic human C35/tyrosinase polytope
QNILLSNAPLGPQFPKLENGGFPVQNILLSNAPLGPQFP

SEQ ID NO: 1506 - protein, 24 aa, Artificial
  synthetic human C35/tyrosinase polytope
KLENGGFPVDYSYLQDSDPDSFQD

SEQ ID NO: 1507 - protein, 39 aa, Artificial
  synthetic human C35/tyrosinase polytope
DYSYLQDSDPDSFQDKLENGGFPVDYSYLQDSDPDSFQD

SEQ ID NO: 1508 - protein, 18 aa, Artificial
  synthetic human C35/Melan-A polytope
KLENGGFPVILTVILGVL

SEQ ID NO: 1509 - protein, 27 aa, Artificial
  synthetic human C35/Melan-A polytope
ILTVILGVLKLENGGFPVILTVILGVL

SEQ ID NO: 1510 - protein, 18 aa, Artificial
  synthetic human C35/gp100 polytope
KLENGGFPVKTWGQYWQV

SEQ ID NO: 1511 - protein, 27 aa, Artificial
  synthetic human C35/gp100 polytope
KTWGQYWQVKLENGGFPVKTWGQYWQV

SEQ ID NO: 1512 - protein, 18 aa, Artificial
  synthetic human C35/gp100 polytope
KLENGGFPVITDQVPFSV

SEQ ID NO: 1513 - protein, 27 aa, Artificial
  synthetic human C35/gp100 polytope
ITDQVPFSVKLENGGFPVITDQVPFSV

SEQ ID NO: 1514 - protein, 18 aa, Artificial
  synthetic human C35/gp100 polytope
KLENGGFPVYLEPGPVTA

SEQ ID NO: 1515 - protein, 27 aa, Artificial
  synthetic human C35/gp100 polytope
YLEPGPVTAKLENGGFPVYLEPGPVTA

SEQ ID NO: 1516 - protein, 19 aa, Artificial
  synthetic human C35/gp100 polytope
KLENGGFPVLLDGTATLRL

SEQ ID NO: 1517 - protein, 29 aa, Artificial
  synthetic human C35/gp100 polytope
LLDGTATLRLKLENGGFPVLLDGTATLRL

SEQ ID NO: 1518 - protein, 19 aa, Artificial
  synthetic human C35/gp100 polytope
KLENGGFPVVLYRYGSFSV

SEQ ID NO: 1519 - protein, 29 aa, Artificial
  synthetic human C35/gp100 polytope
VLYRYGSFSVKLENGGFPVVLYRYGSFSV

SEQ ID NO: 1520 - protein, 18 aa, Artificial
  synthetic human C35/PRAME polytope
KLENGGFPVLYVDSLFFL

SEQ ID NO: 1521 - protein, 27 aa, Artificial
  synthetic human C35/PRAME polytope
LYVDSLFFLKLENGGFPVLYVDSLFFL

SEQ ID NO: 1522 - protein, 21 aa, Artificial
  synthetic human C35/MAGE-6 polytope
KLENGGFPVKISGGPRISYPL

SEQ ID NO: 1523 - protein, 33 aa, Artificial
  synthetic human C35/MAGE-6 polytope
KISGGPRISYPLKLENGGFPVKISGGPRISYPL

SEQ ID NO: 1524 - protein, 33 aa, Artificial; identical to SEQ ID NO: 1523
  synthetic humanc C35/NY-ESO-1 polytope

SEQ ID NO: 1525 - protein, 31 aa, Artificial
  synthetic humanc C35/NY-ESO-1 polytope
SLLMWITQCFLKLENGGFPVSLLMWITQCFL

SEQ ID NO: 1526 - protein, 18 aa, Artificial
  synthetic humanc C35/NY-ESO-1 polytope
KLENGGFPVSLLMWITQC

SEQ ID NO: 1527 - protein, 27 aa, Artificial
  synthetic humanc C35/NY-ESO-1 polytope
SLLMWITQCKLENGGFPVSLLMWITQC

SEQ ID NO: 1528 - protein, 18 aa, Artificial
  synthetic humanc C35/NY-ESO-1 polytope
KLENGGFPVQLSLLMWIT

SEQ ID NO: 1529 - protein, 27 aa, Artificial
  synthetic humanc C35/NY-ESO-1 polytope
QLSLLMWITKLENGGFPVQLSLLMWIT

SEQ ID NO: 1530 - protein, 38 aa, Artificial
  synthetic human C35/NY-ESO-1/MAGE-3 polytope
SLLMWITQCFLPVFKLENGGFPVTSYVKVLHHMVKISG

SEQ ID NO: 1531 - protein, 18 aa, Artificial
  synthetic human  C35/MAGE-1 polytope
KITNSRPPLEADPTGHSY

SEQ ID NO: 1532 - protein, 27 aa, Artificial
  synthetic human C35/MAGE-1 polytope
EADPTGHSYKITNSRPPLEADPTGHSY

SEQ ID NO: 1533 - protein, 18 aa, Artificial
  synthetic human C35/MAGE-1 polytope
KITNSRPPLSAYGEPRKL

SEQ ID NO: 1534 - protein, 27 aa, Artificial
  synthetic human C35/MAGE-1 polytope
SAYGEPRKLKITNSRPPLSAYGEPRKL

SEQ ID NO: 1535 - protein, 18 aa, Artificial
  synthetic human C35/MAGE-3 polytope
KITNSRPPLEVDPIGHLY

SEQ ID NO: 1536 - protein, 27 aa, Artificial
  synthetic human C35/MAGE-3 polytope
EVDPIGHLYKITNSRPPLEVDPIGHLY

SEQ ID NO: 1537 - protein, 18 aa, Artificial
  synthetic human C35/MAGE-3 polytope
KITNSRPPLFLWGPRALV

SEQ ID NO: 1538 - protein, 27 aa, Artificial
  synthetic human C35/MAGE-3 polytope
FLWGPRALVKITNSRPPLFLWGPRALV

SEQ ID NO: 1539 - protein, 19 aa, Artificial
  synthetic human C35/MAGE-3 polytope
KITNSRPPLMEVDPIGHLY

SEQ ID NO: 1540 - protein, 29 aa, Artificial
  synthetic human C35/MAGE-3 polytope
MEVDPIGHLYKITNSRPPLMEVDPIGHLY

SEQ ID NO: 1541 - protein, 18 aa, Artificial
  synthetic human C35/BAGE polytope
KITNSRPPLAARAVFLAL

SEQ ID NO: 1542 - protein, 27 aa, Artificial
  synthetic human C35/BAGE polytope
AARAVFLALKITNSRPPLAARAVFLAL

SEQ ID NO: 1543 - protein, 17 aa, Artificial
  synthetic human C35/GAGE-1,2 polytope
KITNSRPPLYRPRPRRY

SEQ ID NO: 1544 - protein, 25 aa, Artificial
  synthetic human C35/GAGE-1,2 polytope
YRPRPRRYKITNSRPPLYRPRPRRY

SEQ ID NO: 1545 - protein, 19 aa, Artificial
  synthetic human C35/RAGE polytope
KITNSRPPLSPSSNRIRNT

SEQ ID NO: 1546 - protein, 29 aa, Artificial
  synthetic human C35/RAGE polytope
SPSSNRIRNTKITNSRPPLSPSSNRIRNT

SEQ ID NO: 1547 - protein, 19 aa, Artificial
  synthetic human C35/CDK4 polytope
KITNSRPPLARDPHSGHFV

SEQ ID NO: 1548 - protein, 29 aa, Artificial
  synthetic human C35/CDK4 polytope
ARDPHSGHFVKITNSRPPLARDPHSGHFV

SEQ ID NO: 1549 - protein, 18 aa, Artificial
  synthetic human C35/beta-catenin polytope
KITNSRPPLSYLDSGIHS

SEQ ID NO: 1550 - protein, 27 aa, Artificial
  synthetic human C35/beta-catenin polytope
SYLDSGIHSKITNSRPPLSYLDSGIHS

SEQ ID NO: 1551 - protein, 18 aa, Artificial
  synthetic human C35/tyrosinase polytope
KITNSRPPLMLLAVLYCL

SEQ ID NO: 1552 - protein, 27 aa, Artificial
  synthetic human C35/tyrosinase polytope
MLLAVLYCLKITNSRPPLMLLAVLYCL

SEQ ID NO: 1553 - protein, 18 aa, Artificial
  synthetic human C35/tyrosinase polytope
KITNSRPPLAFLPWHRLF

SEQ ID NO: 1554 - protein, 27 aa, Artificial
  synthetic human C35/tyrosinase polytope
AFLPWHRLFKITNSRPPLAFLPWHRLF

SEQ ID NO: 1555 - protein, 24 aa, Artificial
  synthetic human C35/tyrosinase polytope
KITNSRPPLQNILLSNAPLGPQFP

SEQ ID NO: 1556 - protein, 39 aa, Artificial
  synthetic human C35/tyrosinase polytope
QNILLSNAPLGPQFPKITNSRPPLQNILLSNAPLGPQFP

SEQ ID NO: 1557 - protein, 24 aa, Artificial
  synthetic human C35/tyrosinase polytope
KITNSRPPLDYSYLQDSDPDSFQD

SEQ ID NO: 1558 - protein, 39 aa, Artificial
  synthetic human C35/tyrosinase polytope
DYSYLQDSDPDSFQDKITNSRPPLDYSYLQDSDPDSFQD

SEQ ID NO: 1559 - protein, 18 aa, Artificial
  synthetic human C35/Melan-A polytope
KITNSRPPLILTVILGVL

SEQ ID NO: 1560 - protein, 27 aa, Artificial
  synthetic human C35/Melan-A polytope
ILTVILGVLKITNSRPPLILTVILGVL

SEQ ID NO: 1561 - protein, 18 aa, Artificial
  synthetic human C35/gp100 polytope
KITNSRPPLKTWGQYWQV

SEQ ID NO: 1562 - protein, 27 aa, Artificial
  synthetic human C35/gp100 polytope
KTWGQYWQVKITNSRPPLKTWGQYWQV

SEQ ID NO: 1563 - protein, 18 aa, Artificial
  synthetic human C35/gp100 polytope
KITNSRPPLITDQVPFSV

SEQ ID NO: 1564 - protein, 27 aa, Artificial
  synthetic human C35/gp100 polytope
ITDQVPFSVKITNSRPPLITDQVPFSV

SEQ ID NO: 1565 - protein, 18 aa, Artificial
  synthetic human C35/gp100 polytope
KITNSRPPLYLEPGPVTA

SEQ ID NO: 1566 - protein, 27 aa, Artificial
  synthetic human C35/gp100 polytope
YLEPGPVTAKITNSRPPLYLEPGPVTA

SEQ ID NO: 1567 - protein, 19 aa, Artificial
  synthetic human C35/gp100 polytope
KITNSRPPLLLDGTATLRL

SEQ ID NO: 1568 - protein, 29 aa, Artificial
  synthetic human C35/gp100 polytope
LLDGTATLRLKITNSRPPLLLDGTATLRL

SEQ ID NO: 1569 - protein, 19 aa, Artificial
  synthetic human C35/gp100 polytope
KITNSRPPLVLYRYGSFSV

SEQ ID NO: 1570 - protein, 29 aa, Artificial
  synthetic human C35/gp100 polytope
VLYRYGSFSVKITNSRPPLVLYRYGSFSV

SEQ ID NO: 1571 - protein, 18 aa, Artificial
  synthetic human C35/PRAME polytope
KITNSRPPLLYVDSLFFL

SEQ ID NO: 1572 - protein, 27 aa, Artificial
  synthetic human C35/PRAME polytope
LYVDSLFFLKITNSRPPLLYVDSLFFL

SEQ ID NO: 1573 - protein, 21 aa, Artificial
  synthetic human C35/MAGE-6 polytope
KITNSRPPLKISGGPRISYPL

SEQ ID NO: 1574 - protein, 33 aa, Artificial
  synthetic human C35/MAGE-6 polytope
KISGGPRISYPLKITNSRPPLKISGGPRISYPL

SEQ ID NO: 1575 - protein, 20 aa, Artificial
  synthetic human C35/NY-ESO-1 polytope
KITNSRPPLSLLMWITQCFL

SEQ ID NO: 1576 - protein, 31 aa, Artificial
  synthetic human C35/NY-ESO-1 polytope
SLLMWITQCFLKITNSRPPLSLLMWITQCFL

SEQ ID NO: 1577 - protein, 18 aa, Artificial
  synthetic human C35/NY-ESO-1 polytope
KITNSRPPLSLLMWITQC

SEQ ID NO: 1578 - protein, 27 aa, Artificial
  synthetic human C35/NY-ESO-1 polytope
SLLMWITQCKITNSRPPLSLLMWITQC

SEQ ID NO: 1579 - protein, 18 aa, Artificial
  synthetic human C35/NY-ESO-1 polytope
KITNSRPPLQLSLLMWIT

SEQ ID NO: 1580 - protein, 27 aa, Artificial
  synthetic human C35/NY-ESO-1 polytope
QLSLLMWITKITNSRPPLQLSLLMWIT

SEQ ID NO: 1581 - protein, 38 aa, Artificial
  synthetic human C35/NY-ESO-1/MAGE-3 polytope
SLLMWITQCFLPVFKITNSRPPLTSYVKVLHHMVKISG

SEQ ID NO: 1582 - protein, 18 aa, Artificial
  synthetic human C35/MAGE-1 polytope
ILNSRPPAVEADPTGHSY

SEQ ID NO: 1583 - protein, 27 aa, Artificial
  synthetic human C35/MAGE-1 polytope
EADPTGHSYILNSRPPAVEADPTGHSY

SEQ ID NO: 1584 - protein, 18 aa, Artificial
  synthetic human C35/MAGE-1 polytope
ILNSRPPAVSAYGEPRKL

SEQ ID NO: 1585 - protein, 27 aa, Artificial
  synthetic human C35/MAGE-1 polytope
SAYGEPRKLILNSRPPAVSAYGEPRKL

SEQ ID NO: 1586 - protein, 18 aa, Artificial
  synthetic human C35/MAGE-3 polytope
ILNSRPPAVEVDPIGHLY

SEQ ID NO: 1587 - protein, 27 aa, Artificial
  synthetic human C35/MAGE-3 polytope
EVDPIGHLYILNSRPPAVEVDPIGHLY

SEQ ID NO: 1588 - protein, 18 aa, Artificial
  synthetic human C35/MAGE-3 polytope
ILNSRPPAVFLWGPRALV

SEQ ID NO: 1589 - protein, 27 aa, Artificial
  synthetic human C35/MAGE-3 polytope
FLWGPRALVILNSRPPAVFLWGPRALV

SEQ ID NO: 1590 - protein, 19 aa, Artificial
  synthetic human C35/MAGE-3 polytope
ILNSRPPAVMEVDPIGHLY

SEQ ID NO: 1591 - protein, 29 aa, Artificial
  synthetic human C35/MAGE-3 polytope
MEVDPIGHLYILNSRPPAVMEVDPIGHLY

SEQ ID NO: 1592 - protein, 18 aa, Artificial
  synthetic human C35/BAGE polytope
ILNSRPPAVAARAVFLAL

SEQ ID NO: 1593 - protein, 27 aa, Artificial
  synthetic human C35/BAGE polytope
AARAVFLALILNSRPPAVAARAVFLAL

SEQ ID NO: 1594 - protein, 17 aa, Artificial
  synthetic human C35/GAGE-1,2 polytope
ILNSRPPAVYRPRPRRY

SEQ ID NO: 1595 - protein, 25 aa, Artificial
  synthetic human C35/GAGE-1,2 polytope
YRPRPRRYILNSRPPAVYRPRPRRY

SEQ ID NO: 1596 - protein, 19 aa, Artificial
  synthetic human C35/RAGE polytope
ILNSRPPAVSPSSNRIRNT

SEQ ID NO: 1597 - protein, 29 aa, Artificial
  synthetic human C35/RAGE polytope
SPSSNRIRNTILNSRPPAVSPSSNRIRNT

SEQ ID NO: 1598 - protein, 19 aa, Artificial
  synthetic human C35/CDK4 polytope
ILNSRPPAVARDPHSGHFV

SEQ ID NO: 1599 - protein, 29 aa, Artificial
  synthetic human C35/CDK4 polytope
ARDPHSGHFVILNSRPPAVARDPHSGHFV

SEQ ID NO: 1600 - protein, 18 aa, Artificial
  synthetic human C35/beta-catenin polytope
ILNSRPPAVSYLDSGIHS

SEQ ID NO: 1601 - protein, 27 aa, Artificial
  synthetic human C35/beta-catenin polytope
SYLDSGIHSILNSRPPAVSYLDSGIHS

SEQ ID NO: 1602 - protein, 18 aa, Artificial
  synthetic human C35/tyrosinase polytope
ILNSRPPAVMLLAVLYCL

SEQ ID NO: 1603 - protein, 27 aa, Artificial
  synthetic human C35/tyrosinase polytope
MLLAVLYCLILNSRPPAVMLLAVLYCL

SEQ ID NO: 1604 - protein, 18 aa, Artificial
  synthetic human C35/tyrosinase polytope
ILNSRPPAVAFLPWHRLF

SEQ ID NO: 1605 - protein, 27 aa, Artificial
  synthetic human C35/tyrosinase polytope
AFLPWHRLFILNSRPPAVAFLPWHRLF

SEQ ID NO: 1606 - protein, 24 aa, Artificial
  synthetic human C35/tyrosinase polytope
ILNSRPPAVQNILLSNAPLGPQFP

SEQ ID NO: 1607 - protein, 39 aa, Artificial
  synthetic human C35/tyrosinase polytope
QNILLSNAPLGPQFPILNSRPPAVQNILLSNAPLGPQFP

SEQ ID NO: 1608 - protein, 24 aa, Artificial
  synthetic human C35/tyrosinase polytope
ILNSRPPAVDYSYLQDSDPDSFQD

SEQ ID NO: 1609 - protein, 39 aa, Artificial
  synthetic human C35/tyrosinase polytope
DYSYLQDSDPDSFQDILNSRPPAVDYSYLQDSDPDSFQD

SEQ ID NO: 1610 - protein, 18 aa, Artificial
  synthetic human C35/Melan-A polytope
ILNSRPPAVILTVILGVL

SEQ ID NO: 1611 - protein, 27 aa, Artificial
  synthetic human C35/Melan-A polytope
ILTVILGVLILNSRPPAVILTVILGVL

SEQ ID NO: 1612 - protein, 18 aa, Artificial
  synthetic human C35/gp100 polytope
ILNSRPPAVKTWGQYWQV

SEQ ID NO: 1613 - protein, 27 aa, Artificial
  synthetic human C35/gp100 polytope
KTWGQYWQVILNSRPPAVKTWGQYWQV

SEQ ID NO: 1614 - protein, 18 aa, Artificial
  synthetic human C35/gp100 polytope
ILNSRPPAVITDQVPFSV

SEQ ID NO: 1615 - protein, 27 aa, Artificial
  synthetic human C35/gp100 polytope
ITDQVPFSVILNSRPPAVITDQVPFSV

SEQ ID NO: 1616 - protein, 18 aa, Artificial
  synthetic human C35/gp100 polytope
ILNSRPPAVYLEPGPVTA

SEQ ID NO: 1617 - protein, 27 aa, Artificial
  synthetic human C35/gp100 polytope
YLEPGPVTAILNSRPPAVYLEPGPVTA

SEQ ID NO: 1618 - protein, 19 aa, Artificial
  synthetic human C35/gp100 polytope
ILNSRPPAVLLDGTATLRL

SEQ ID NO: 1619 - protein, 29 aa, Artificial
  synthetic human C35/gp100 polytope
LLDGTATLRLILNSRPPAVLLDGTATLRL

SEQ ID NO: 1620 - protein, 19 aa, Artificial
  synthetic human C35/gp100 polytope
ILNSRPPAVVLYRYGSFSV

SEQ ID NO: 1621 - protein, 29 aa, Artificial
  synthetic human C35/gp100 polytope
VLYRYGSFSVILNSRPPAVVLYRYGSFSV

SEQ ID NO: 1622 - protein, 18 aa, Artificial
  synthetic human C35/PRAME polytope
ILNSRPPAVLYVDSLFFL

SEQ ID NO: 1623 - protein, 27 aa, Artificial
  synthetic human C35/PRAME polytope
LYVDSLFFLILNSRPPAVLYVDSLFFL

SEQ ID NO: 1624 - protein, 21 aa, Artificial
  synthetic human C35/MAGE-6 polytope
ILNSRPPAVKISGGPRISYPL

SEQ ID NO: 1625 - protein, 33 aa, Artificial
  synthetic human C35/MAGE-6 polytope
KISGGPRISYPLILNSRPPAVKISGGPRISYPL

SEQ ID NO: 1626 - protein, 20 aa, Artificial
  synthetic human C35/NY-ESO-1 polytope
ILNSRPPAVSLLMWITQCFL

SEQ ID NO: 1627 - protein, 32 aa, Artificial
  synthetic human C35/NY-ESO-1 polytope
SLLMWITQCFLILNSRPPAVVSLLMWITQCFL

SEQ ID NO: 1628 - protein, 18 aa, Artificial
  synthetic human C35/NY-ESO-1 polytope
ILNSRPPAVSLLMWITQC

SEQ ID NO: 1629 - protein, 27 aa, Artificial
  synthetic human C35/NY-ESO-1 polytope
SLLMWITQCILNSRPPAVSLLMWITQC

SEQ ID NO: 1630 - protein, 18 aa, Artificial
  synthetic human C35/NY-ESO-1 polytope
ILNSRPPAVQLSLLMWIT

SEQ ID NO: 1631 - protein, 27 aa, Artificial
  synthetic human C35/NY-ESO-1 polytope
QLSLLMWITILNSRPPAVQLSLLMWIT

SEQ ID NO: 1632 - protein, 38 aa, Artificial
  synthetic human C35/NY-ESO-1/MAGE-3 polytope
SLLMWITQCFLPVFILNSRPPAVTSYVKVLHHMVKISG

SEQ ID NO: 1633 - protein, 18 aa, Artificial
  synthetic human C35/MAGE-1 polytope
IMNSRPPAVEADPTGHSY

SEQ ID NO: 1634 - protein, 27 aa, Artificial
  synthetic human C35/MAGE-1 polytope
EADPTGHSYIMNSRPPAVEADPTGHSY

SEQ ID NO: 1635 - protein, 18 aa, Artificial
  synthetic human C35/MAGE-1 polytope
IMNSRPPAVSAYGEPRKL

SEQ ID NO: 1636 - protein, 27 aa, Artificial
  synthetic human C35/MAGE-1 polytope
SAYGEPRKLIMNSRPPAVSAYGEPRKL

SEQ ID NO: 1637 - protein, 18 aa, Artificial
  synthetic human C35/MAGE-3 polytope
IMNSRPPAVEVDPIGHLY

SEQ ID NO: 1638 - protein, 27 aa, Artificial
  synthetic human C35/MAGE-3 polytope
EVDPIGHLYIMNSRPPAVEVDPIGHLY

SEQ ID NO: 1639 - protein, 18 aa, Artificial
  synthetic human C35/MAGE-3 polytope
IMNSRPPAVFLWGPRALV

SEQ ID NO: 1640 - protein, 27 aa, Artificial
  synthetic human C35/MAGE-3 polytope
FLWGPRALVIMNSRPPAVFLWGPRALV

SEQ ID NO: 1641 - protein, 19 aa, Artificial
  synthetic human C35/MAGE-3 polytope
IMNSRPPAVMEVDPIGHLY

SEQ ID NO: 1642 - protein, 29 aa, Artificial
  synthetic human C35/MAGE-3 polytope
MEVDPIGHLYIMNSRPPAVMEVDPIGHLY

SEQ ID NO: 1643 - protein, 18 aa, Artificial
  synthetic human C35/BAGE polytope
IMNSRPPAVAARAVFLAL

SEQ ID NO: 1644 - protein, 27 aa, Artificial
  synthetic human C35/BAGE polytope
AARAVFLALIMNSRPPAVAARAVFLAL

SEQ ID NO: 1645 - protein, 17 aa, Artificial
  synthetic human C35/GAGE-1,2 polytope
IMNSRPPAVYRPRPRRY

SEQ ID NO: 1646 - protein, 25 aa, Artificial
  synthetic human C35/GAGE-1,2 polytope
YRPRPRRYIMNSRPPAVYRPRPRRY

SEQ ID NO: 1647 - protein, 19 aa, Artificial
  synthetic human C35/RAGE polytope
IMNSRPPAVSPSSNRIRNT

SEQ ID NO: 1648 - protein, 29 aa, Artificial
  synthetic human C35/RAGE polytope
SPSSNRIRNTIMNSRPPAVSPSSNRIRNT

SEQ ID NO: 1649 - protein, 19 aa, Artificial
  synthetic human C35/CDK4 polytope
IMNSRPPAVARDPHSGHFV

SEQ ID NO: 1650 - protein, 29 aa, Artificial
  synthetic human C35/CDK4 polytope
ARDPHSGHFVIMNSRPPAVARDPHSGHFV

SEQ ID NO: 1651 - protein, 18 aa, Artificial
  synthetic human C35/beta-catenin polytope
IMNSRPPAVSYLDSGIHS

SEQ ID NO: 1652 - protein, 27 aa, Artificial
  synthetic human C35/beta-catenin polytope
SYLDSGIHSIMNSRPPAVSYLDSGIHS

SEQ ID NO: 1653 - protein, 18 aa, Artificial
  synthetic human C35/tyrosinase polytope
IMNSRPPAVMLLAVLYCL

SEQ ID NO: 1654 - protein, 27 aa, Artificial
  synthetic human C35/tyrosinase polytope
MLLAVLYCLIMNSRPPAVMLLAVLYCL

SEQ ID NO: 1655 - protein, 18 aa, Artificial
  synthetic human C35/tyrosinase polytope
IMNSRPPAVAFLPWHRLF

SEQ ID NO: 1656 - protein, 27 aa, Artificial
  synthetic human C35/tyrosinase polytope
AFLPWHRLFIMNSRPPAVAFLPWHRLF

SEQ ID NO: 1657 - protein, 24 aa, Artificial
  synthetic human C35/tyrosinase polytope
IMNSRPPAVQNILLSNAPLGPQFP

SEQ ID NO: 1658 - protein, 39 aa, Artificial
  synthetic human C35/tyrosinase polytope
QNILLSNAPLGPQFPIMNSRPPAVQNILLSNAPLGPQFP

SEQ ID NO: 1659 - protein, 24 aa, Artificial
  synthetic human C35/tyrosinase polytope
IMNSRPPAVDYSYLQDSDPDSFQD

SEQ ID NO: 1660 - protein, 39 aa, Artificial
  synthetic human C35/tyrosinase polytope
DYSYLQDSDPDSFQDIMNSRPPAVDYSYLQDSDPDSFQD

SEQ ID NO: 1661 - protein, 18 aa, Artificial
  synthetic human C35/Melan-A polytope
IMNSRPPAVILTVILGVL

SEQ ID NO: 1662 - protein, 27 aa, Artificial
  synthetic human C35/Melan-A polytope
ILTVILGVLIMNSRPPAVILTVILGVL

SEQ ID NO: 1663 - protein, 18 aa, Artificial
  synthetic human C35/gp100 polytope
IMNSRPPAVKTWGQYWQV

SEQ ID NO: 1664 - protein, 27 aa, Artificial
  synthetic human C35/gp100 polytope
KTWGQYWQVIMNSRPPAVKTWGQYWQV

SEQ ID NO: 1665 - protein, 18 aa, Artificial
  synthetic human C35/gp100 polytope
IMNSRPPAVITDQVPFSV

SEQ ID NO: 1666 - protein, 27 aa, Artificial
  synthetic human C35/gp100 polytope
ITDQVPFSVIMNSRPPAVITDQVPFSV

SEQ ID NO: 1667 - protein, 18 aa, Artificial
  synthetic human C35/gp100 polytope
IMNSRPPAVYLEPGPVTA

SEQ ID NO: 1668 - protein, 27 aa, Artificial
  synthetic human C35/gp100 polytope
YLEPGPVTAIMNSRPPAVYLEPGPVTA

SEQ ID NO: 1669 - protein, 19 aa, Artificial
  synthetic human C35/gp100 polytope
IMNSRPPAVLLDGTATLRL

SEQ ID NO: 1670 - protein, 29 aa, Artificial
  synthetic human C35/gp100 polytope
LLDGTATLRLIMNSRPPAVLLDGTATLRL

SEQ ID NO: 1671 - protein, 19 aa, Artificial
  synthetic human C35/gp100 polytope
IMNSRPPAVVLYRYGSFSV

SEQ ID NO: 1672 - protein, 29 aa, Artificial
  synthetic human C35/gp100 polytope
VLYRYGSFSVIMNSRPPAVVLYRYGSFSV

SEQ ID NO: 1673 - protein, 18 aa, Artificial
  synthetic human C35/PRAME polytope
IMNSRPPAVLYVDSLFFL

SEQ ID NO: 1674 - protein, 27 aa, Artificial
  synthetic human C35/PRAME polytope
LYVDSLFFLIMNSRPPAVLYVDSLFFL

SEQ ID NO: 1675 - protein, 21 aa, Artificial
  synthetic human C35/MAGE-6 polytope
IMNSRPPAVKISGGPRISYPL

SEQ ID NO: 1676 - protein, 33 aa, Artificial
  synthetic human C35/MAGE-6 polytope
KISGGPRISYPLIMNSRPPAVKISGGPRISYPL

SEQ ID NO: 1677 - protein, 20 aa, Artificial
  synthetic human C35/NY-ESO-1 polytope
IMNSRPPAVSLLMWITQCFL

SEQ ID NO: 1678 - protein, 31 aa, Artificial
  synthetic human C35/NY-ESO-1 polytope
SLLMWITQCFLITNSRPPAVSLLMWITQCFL

SEQ ID NO: 1679 - protein, 18 aa, Artificial
  synthetic human C35/NY-ESO-1 polytope
IMNSRPPAVSLLMWITQC

SEQ ID NO: 1680 - protein, 27 aa, Artificial
  synthetic human C35/NY-ESO-1 polytope
SLLMWITQCIMNSRPPAVSLLMWITQC

SEQ ID NO: 1681 - protein, 18 aa, Artificial
  synthetic human C35/NY-ESO-1 polytope
IMNSRPPAVQLSLLMWIT

SEQ ID NO: 1682 - protein, 27 aa, Artificial
  synthetic human C35/NY-ESO-1 polytope
QLSLLMWITIMNSRPPAVQLSLLMWIT

SEQ ID NO: 1683 - protein, 38 aa, Artificial
  synthetic human C35/NY-ESO-1/MAGE-3 polytope
SLLMWITQCFLPVFIMNSRPPAVTSYVKVLHHMVKISG

SEQ ID NO: 1684 - protein, 18 aa, Artificial
  synthetic human C35/MAGE-1 polytope
ITNSRPPSVEADPTGHSY

SEQ ID NO: 1685 - protein, 27 aa, Artificial
  synthetic human C35/MAGE-1 polytope
EADPTGHSYITNSRPPSVEADPTGHSY

SEQ ID NO: 1686 - protein, 18 aa, Artificial
  synthetic human C35/MAGE-1 polytope
ITNSRPPSVSAYGEPRKL

SEQ ID NO: 1687 - protein, 27 aa, Artificial
  synthetic human C35/MAGE-1 polytope
SAYGEPRKLITNSRPPSVSAYGEPRKL

SEQ ID NO: 1688 - protein, 18 aa, Artificial
  synthetic human C35/MAGE-3 polytope
ITNSRPPSVEVDPIGHLY

SEQ ID NO: 1689 - protein, 27 aa, Artificial
  synthetic human C35/MAGE-3 polytope
EVDPIGHLYITNSRPPSVEVDPIGHLY

SEQ ID NO: 1690 - protein, 18 aa, Artificial
  synthetic human C35/MAGE-3 polytope
ITNSRPPSVFLWGPRALV

SEQ ID NO: 1691 - protein, 27 aa, Artificial
  synthetic human C35/MAGE-3 polytope
FLWGPRALVITNSRPPSVFLWGPRALV

SEQ ID NO: 1692 - protein, 19 aa, Artificial
  synthetic human C35/MAGE-3 polytope
ITNSRPPSVMEVDPIGHLY

SEQ ID NO: 1693 - protein, 29 aa, Artificial
  synthetic human C35/MAGE-3 polytope
MEVDPIGHLYITNSRPPSVMEVDPIGHLY

SEQ ID NO: 1694 - protein, 18 aa, Artificial
  synthetic human C35/BAGE polytope
ITNSRPPSVAARAVFLAL

SEQ ID NO: 1695 - protein, 27 aa, Artificial
  synthetic human C35/BAGE polytope
AARAVFLALITNSRPPSVAARAVFLAL

SEQ ID NO: 1696 - protein, 17 aa, Artificial
  synthetic human C35/GAGE-1,2 polytope
ITNSRPPSVYRPRPRRY

SEQ ID NO: 1697 - protein, 25 aa, Artificial
  synthetic human C35/GAGE-1,2 polytope
YRPRPRRYITNSRPPSVYRPRPRRY

SEQ ID NO: 1698 - protein, 19 aa, Artificial
  synthetic human C35/RAGE polytope
ITNSRPPSVSPSSNRIRNT

SEQ ID NO: 1699 - protein, 29 aa, Artificial
  synthetic human C35/RAGE polytope
SPSSNRIRNTITNSRPPSVSPSSNRIRNT

SEQ ID NO: 1700 - protein, 19 aa, Artificial
  synthetic human C35/CDK4 polytope
ITNSRPPSVARDPHSGHFV

SEQ ID NO: 1701 - protein, 29 aa, Artificial
  synthetic human C35/CDK4 polytope
ARDPHSGHFVITNSRPPSVARDPHSGHFV

SEQ ID NO: 1702 - protein, 18 aa, Artificial
  synthetic human C35/beta-catenin polytope
ITNSRPPSVSYLDSGIHS

SEQ ID NO: 1703 - protein, 27 aa, Artificial
  synthetic human C35/beta-catenin polytope
SYLDSGIHSITNSRPPSVSYLDSGIHS

SEQ ID NO: 1704 - protein, 18 aa, Artificial
  synthetic human C35/tyrosinase
ITNSRPPSVMLLAVLYCL

SEQ ID NO: 1705 - protein, 27 aa, Artificial
  synthetic human C35/tyrosinase
MLLAVLYCLITNSRPPSVMLLAVLYCL

SEQ ID NO: 1706 - protein, 18 aa, Artificial
  synthetic human C35/tyrosinase
ITNSRPPSVAFLPWHRLF

SEQ ID NO: 1707 - protein, 27 aa, Artificial
  synthetic human C35/tyrosinase
AFLPWHRLFITNSRPPSVAFLPWHRLF

SEQ ID NO: 1708 - protein, 24 aa, Artificial
  synthetic human C35/tyrosinase
ITNSRPPSVQNILLSNAPLGPQFP

SEQ ID NO: 1709 - protein, 39 aa, Artificial
  synthetic human C35/tyrosinase
QNILLSNAPLGPQFPITNSRPPSVQNILLSNAPLGPQFP

SEQ ID NO: 1710 - protein, 24 aa, Artificial
  synthetic human C35/tyrosinase
ITNSRPPSVDYSYLQDSDPDSFQD

SEQ ID NO: 1711 - protein, 39 aa, Artificial
  synthetic human C35/tyrosinase
DYSYLQDSDPDSFQDITNSRPPSVDYSYLQDSDPDSFQD

SEQ ID NO: 1712 - protein, 18 aa, Artificial
  synthetic human C35/Melan-A polytope
ITNSRPPSVILTVILGVL

SEQ ID NO: 1713 - protein, 27 aa, Artificial
  synthetic human C35/Melan-A polytope
ILTVILGVLITNSRPPSVILTVILGVL

SEQ ID NO: 1714 - protein, 18 aa, Artificial
  synthetic human C35/gp100 polytope
ITNSRPPSVKTWGQYWQV

SEQ ID NO: 1715 - protein, 27 aa, Artificial
  synthetic human C35/gp100 polytope
KTWGQYWQVITNSRPPSVKTWGQYWQV

SEQ ID NO: 1716 - protein, 18 aa, Artificial
  synthetic human C35/gp100 polytope
ITNSRPPSVITDQVPFSV

SEQ ID NO: 1717 - protein, 27 aa, Artificial
  synthetic human C35/gp100 polytope
ITDQVPFSVITNSRPPSVITDQVPFSV

SEQ ID NO: 1718 - protein, 18 aa, Artificial
  synthetic human C35/gp100 polytope
ITNSRPPSVYLEPGPVTA

SEQ ID NO: 1719 - protein, 27 aa, Artificial
  synthetic human C35/gp100 polytope
YLEPGPVTAITNSRPPSVYLEPGPVTA

SEQ ID NO: 1720 - protein, 19 aa, Artificial
  synthetic human C35/gp100 polytope
ITNSRPPSVLLDGTATLRL

SEQ ID NO: 1721 - protein, 29 aa, Artificial
  synthetic human C35/gp100 polytope
LLDGTATLRLITNSRPPSVLLDGTATLRL

SEQ ID NO: 1722 - protein, 19 aa, Artificial
  synthetic human C35/gp100 polytope
ITNSRPPSVVLYRYGSFSV

SEQ ID NO: 1723 - protein, 29 aa, Artificial
  synthetic human C35/gp100 polytope
VLYRYGSFSVITNSRPPSVVLYRYGSFSV

SEQ ID NO: 1724 - protein, 18 aa, Artificial
  synthetic human C35/PRAME polytope
ITNSRPPSVLYVDSLFFL

SEQ ID NO: 1725 - protein, 27 aa, Artificial
  synthetic human C35/PRAME polytope
LYVDSLFFLITNSRPPSVLYVDSLFFL

SEQ ID NO: 1726 - protein, 21 aa, Artificial
  synthetic human C35/MAGE-6 polytope
ITNSRPPSVKISGGPRISYPL

SEQ ID NO: 1727 - protein, 33 aa, Artificial
  synthetic human C35/MAGE-6 polytope
KISGGPRISYPLITNSRPPSVKISGGPRISYPL

SEQ ID NO: 1728 - protein, 20 aa, Artificial
  synthetic human C35/NY-ESO-1 polytope
ITNSRPPSVSLLMWITQCFL

SEQ ID NO: 1729 - protein, 31 aa, Artificial
  synthetic human C35/NY-ESO-1 polytope
SLLMWITQCFLITNSRPPSVSLLMWITQCFL

SEQ ID NO: 1730 - protein, 18 aa, Artificial
  synthetic human C35/NY-ESO-1 polytope
ITNSRPPSVSLLMWITQC

SEQ ID NO: 1731 - protein, 27 aa, Artificial
  synthetic human C35/NY-ESO-1 polytope
SLLMWITQCITNSRPPSVSLLMWITQC

SEQ ID NO: 1732 - protein, 18 aa, Artificial
  synthetic human C35/NY-ESO-1 polytope
ITNSRPPSVQLSLLMWIT

SEQ ID NO: 1733 - protein, 27 aa, Artificial
  synthetic human C35/NY-ESO-1 polytope
QLSLLMWITIMNSRPPSVQLSLLMWIT

SEQ ID NO: 1734 - protein, 38 aa, Artificial
  synthetic human C35/NY-ESO-1/MAGE-3 polytope
SLLMWITQCFLPVFITNSRPPSVTSYVKVLHHMVKISG

SEQ ID NO: 1735 - protein, 19 aa, Artificial
  synthetic human C35/MAGE-1 polytope
KITNSRPPSVEADPTGHSY

SEQ ID NO: 1736 - protein, 28 aa, Artificial
  synthetic human C35/MAGE-1 polytope
EADPTGHSYKITNSRPPSVEADPTGHSY

SEQ ID NO: 1737 - protein, 19 aa, Artificial
  synthetic human C35/MAGE-1 polytope
KITNSRPPSVSAYGEPRKL

SEQ ID NO: 1738 - protein, 28 aa, Artificial
  synthetic human C35/MAGE-1 polytope
SAYGEPRKLKITNSRPPSVSAYGEPRKL

SEQ ID NO: 1739 - protein, 19 aa, Artificial
  synthetic human C35/MAGE-3 polytope
KITNSRPPSVEVDPIGHLY

SEQ ID NO: 1740 - protein, 28 aa, Artificial
  synthetic human C35/MAGE-3 polytope
EVDPIGHLYKITNSRPPSVEVDPIGHLY

SEQ ID NO: 1741 - protein, 19 aa, Artificial
  synthetic human C35/MAGE-3 polytope
KITNSRPPSVFLWGPRALV

SEQ ID NO: 1742 - protein, 28 aa, Artificial
  synthetic human C35/MAGE-3 polytope
FLWGPRALVKITNSRPPSVFLWGPRALV

SEQ ID NO: 1743 - protein, 20 aa, Artificial
  synthetic human C35/MAGE-3 polytope
KITNSRPPSVMEVDPIGHLY

SEQ ID NO: 1744 - protein, 30 aa, Artificial
  synthetic human C35/MAGE-3 polytope
MEVDPIGHLYKITNSRPPSVMEVDPIGHLY

SEQ ID NO: 1745 - protein, 19 aa, Artificial
  synthetic human C35/BAGE polytope
KITNSRPPSVAARAVFLAL

SEQ ID NO: 1746 - protein, 28 aa, Artificial
  synthetic human C35/BAGE polytope
AARAVFLALKITNSRPPSVAARAVFLAL

SEQ ID NO: 1747 - protein, 18 aa, Artificial
  synthetic human C35/GAGE-1,2 polytope
KITNSRPPSVYRPRPRRY

SEQ ID NO: 1748 - protein, 26 aa, Artificial
  synthetic human C35/GAGE-1,2 polytope
YRPRPRRYKITNSRPPSVYRPRPRRY

SEQ ID NO: 1749 - protein, 20 aa, Artificial
  synthetic human C35/RAGE polytope
KITNSRPPSVSPSSNRIRNT

SEQ ID NO: 1750 - protein, 30 aa, Artificial
  synthetic human C35/RAGE polytope
SPSSNRIRNTKITNSRPPSVSPSSNRIRNT

SEQ ID NO: 1751 - protein, 20 aa, Artificial
  synthetic human C35/CDK4 polytope
KITNSRPPSVARDPHSGHFV

SEQ ID NO: 1752 - protein, 30 aa, Artificial
  synthetic human C35/CDK4 polytope
ARDPHSGHFVKITNSRPPSVARDPHSGHFV

SEQ ID NO: 1753 - protein, 19 aa, Artificial
  synthetic human C35/beta-catenin polytope
KITNSRPPSVSYLDSGIHS

SEQ ID NO: 1754 - protein, 28 aa, Artificial
  synthetic human C35/beta-catenin polytope
SYLDSGIHSKITNSRPPSVSYLDSGIHS

SEQ ID NO: 1755 - protein, 19 aa, Artificial
  synthetic human C25/tyrosinase polytope
KITNSRPPSVMLLAVLYCL

SEQ ID NO: 1756 - protein, 28 aa, Artificial
  synthetic human C25/tyrosinase polytope
MLLAVLYCLKITNSRPPSVMLLAVLYCL

SEQ ID NO: 1757 - protein, 19 aa, Artificial
  synthetic human C25/tyrosinase polytope
KITNSRPPSVAFLPWHRLF

SEQ ID NO: 1758 - protein, 28 aa, Artificial
  synthetic human C25/tyrosinase polytope
AFLPWHRLFKITNSRPPSVAFLPWHRLF

SEQ ID NO: 1759 - protein, 25 aa, Artificial
  synthetic human C25/tyrosinase polytope
KITNSRPPSVQNILLSNAPLGPQFP

SEQ ID NO: 1760 - protein, 40 aa, Artificial
  synthetic human C25/tyrosinase polytope
QNILLSNAPLGPQFPKITNSRPPSVQNILLSNAPLGPQFP

SEQ ID NO: 1761 - protein, 25 aa, Artificial
  synthetic human C25/tyrosinase polytope
KITNSRPPSVDYSYLQDSDPDSFQD

SEQ ID NO: 1762 - protein, 40 aa, Artificial
  synthetic human C25/tyrosinase polytope
DYSYLQDSDPDSFQDKITNSRPPSVDYSYLQDSDPDSFQD

SEQ ID NO: 1763 - protein, 19 aa, Artificial
  synthetic human C35/Melan-A polytope
KITNSRPPSVILTVILGVL

SEQ ID NO: 1764 - protein, 28 aa, Artificial
  synthetic human C35/Melan-A polytope
ILTVILGVLKITNSRPPSVILTVILGVL

SEQ ID NO: 1765 - protein, 19 aa, Artificial
  synthetic human C35/gp100 polytope
KITNSRPPSVKTWGQYWQV

SEQ ID NO: 1766 - protein, 28 aa, Artificial
  synthetic human C35/gp100 polytope
KTWGQYWQVKITNSRPPSVKTWGQYWQV

SEQ ID NO: 1767 - protein, 19 aa, Artificial
  synthetic human C35/gp100 polytope
KITNSRPPSVITDQVPFSV

SEQ ID NO: 1768 - protein, 28 aa, Artificial
  synthetic human C35/gp100 polytope
ITDQVPFSVKITNSRPPSVITDQVPFSV

SEQ ID NO: 1769 - protein, 19 aa, Artificial
  synthetic human C35/gp100 polytope
KITNSRPPSVYLEPGPVTA

SEQ ID NO: 1770 - protein, 28 aa, Artificial
  synthetic human C35/gp100 polytope
YLEPGPVTAKITNSRPPSVYLEPGPVTA

SEQ ID NO: 1771 - protein, 20 aa, Artificial
  synthetic human C35/gp100 polytope
KITNSRPPSVLLDGTATLRL

SEQ ID NO: 1772 - protein, 30 aa, Artificial
  synthetic human C35/gp100 polytope
LLDGTATLRLKITNSRPPSVLLDGTATLRL

SEQ ID NO: 1773 - protein, 20 aa, Artificial
  synthetic human C35/gp100 polytope
KITNSRPPSVVLYRYGSFSV

SEQ ID NO: 1774 - protein, 30 aa, Artificial
  synthetic human C35/gp100 polytope
VLYRYGSFSVKITNSRPPSVVLYRYGSFSV

SEQ ID NO: 1775 - protein, 19 aa, Artificial
  synthetic human C35/PRAME polytope
KITNSRPPSVLYVDSLFFL

SEQ ID NO: 1776 - protein, 28 aa, Artificial
  synthetic human C35/PRAME polytope
LYVDSLFFLKITNSRPPSVLYVDSLFFL

SEQ ID NO: 1777 - protein, 22 aa, Artificial
  synthetic human C35/MAGE-6 polytope
KITNSRPPSVKISGGPRISYPL

SEQ ID NO: 1778 - protein, 34 aa, Artificial
  synthetic human C35/MAGE-6 polytope
KISGGPRISYPLKITNSRPPSVKISGGPRISYPL

SEQ ID NO: 1779 - protein, 21 aa, Artificial
  synthetic human C35/NY-ESO-1 polytope
KITNSRPPSVSLLMWITQCFL

SEQ ID NO: 1780 - protein, 32 aa, Artificial
  synthetic human C35/NY-ESO-1 polytope
SLLMWITQCFLKITNSRPPSVSLLMWITQCFL

SEQ ID NO: 1781 - protein, 19 aa, Artificial
  synthetic human C35/NY-ESO-1 polytope
KITNSRPPSVSLLMWITQC

SEQ ID NO: 1782 - protein, 28 aa, Artificial
  synthetic human C35/NY-ESO-1 polytope
SLLMWITQCKITNSRPPSVSLLMWITQC

SEQ ID NO: 1783 - protein, 19 aa, Artificial
  synthetic human C35/NY-ESO-1 polytope
KITNSRPPSVQLSLLMWIT

SEQ ID NO: 1784 - protein, 28 aa, Artificial
  synthetic human C35/NY-ESO-1 polytope
QLSLLMWITKITNSRPPSVQLSLLMWIT

SEQ ID NO: 1785 - protein, 39 aa, Artificial
  synthetic human C35/NY-ESO-1/MAGE-3 polytope
SLLMWITQCFLPVFKITNSRPPSVTSYVKVLHHMVKISG

SEQ ID NO: 1786 - protein, 18 aa, Artificial
  synthetic human C35/MAGE-1 polytope
GVRIVVEYAEADPTGHSY

SEQ ID NO: 1787 - protein, 27 aa, Artificial
  synthetic human C35/MAGE-1 polytope
EADPTGHSYGVRIVVEYAEADPTGHSY

SEQ ID NO: 1788 - protein, 18 aa, Artificial
  synthetic human C35/MAGE-1 polytope
GVRIVVEYASAYGEPRKL

SEQ ID NO: 1789 - protein, 27 aa, Artificial
  synthetic human C35/MAGE-1 polytope
SAYGEPRKLGVRIVVEYASAYGEPRKL

SEQ ID NO: 1790 - protein, 18 aa, Artificial
  synthetic human C35/MAGE-3 polytope
GVRIVVEYAEVDPIGHLY

SEQ ID NO: 1791 - protein, 27 aa, Artificial
  synthetic human C35/MAGE-3 polytope
EVDPIGHLYGVRIVVEYAEVDPIGHLY

SEQ ID NO: 1792 - protein, 18 aa, Artificial
  synthetic human C35/MAGE-3 polytope
GVRIVVEYAFLWGPRALV

SEQ ID NO: 1793 - protein, 27 aa, Artificial
  synthetic human C35/MAGE-3 polytope
FLWGPRALVGVRIVVEYAFLWGPRALV

SEQ ID NO: 1794 - protein, 19 aa, Artificial
  synthetic human C35/MAGE-3 polytope
GVRIVVEYAMEVDPIGHLY

SEQ ID NO: 1795 - protein, 29 aa, Artificial
  synthetic human C35/MAGE-3 polytope
MEVDPIGHLYGVRIVVEYAMEVDPIGHLY

SEQ ID NO: 1796 - protein, 18 aa, Artificial
  synthetic human C35/BAGE polytope
GVRIVVEYAAARAVFLAL

SEQ ID NO: 1797 - protein, 27 aa, Artificial
  synthetic human C35/BAGE polytope
AARAVFLALGVRIVVEYAAARAVFLAL

SEQ ID NO: 1798 - protein, 17 aa, Artificial
  synthetic human C35/GAGE-1,2 polytope
GVRIVVEYAYRPRPRRY

SEQ ID NO: 1799 - protein, 25 aa, Artificial
  synthetic human C35/GAGE-1,2 polytope
YRPRPRRYGVRIVVEYAYRPRPRRY

SEQ ID NO: 1800 - protein, 18 aa, Artificial
  synthetic human C35/gp100 polytope
GVRIVVEYAYLEPGPVTA

SEQ ID NO: 1801 - protein, 27 aa, Artificial
  synthetic human C35/gp100 polytope
YLEPGPVTAGVRIVVEYAYLEPGPVTA

SEQ ID NO: 1802 - protein, 19 aa, Artificial
  synthetic human C35/gp100 polytope
GVRIVVEYALLDGTATLRL

SEQ ID NO: 1803 - protein, 29 aa, Artificial
  synthetic human C35/gp100 polytope
LLDGTATLRLGVRIVVEYALLDGTATLRL

SEQ ID NO: 1804 - protein, 19 aa, Artificial
  synthetic human C35/gp100 polytope
KLENGGFPVVLYRYGSFSV

SEQ ID NO: 1805 - protein, 29 aa, Artificial
  synthetic human C35/gp100 polytope
VLYRYGSFSVKLENGGFPVVLYRYGSFSV

SEQ ID NO: 1806 - protein, 18 aa, Artificial
  synthetic human C35/PRAME polytope
GVRIVVEYALYVDSLFFL

SEQ ID NO: 1807 - protein, 27 aa, Artificial
  synthetic human C35/PRAME polytope
LYVDSLFFLGVRIVVEYALYVDSLFFL

SEQ ID NO: 1808 - protein, 21 aa, Artificial
  synthetic human C35/MAGE-6 polytope
GVRIVVEYAKISGGPRISYPL

SEQ ID NO: 1809 - protein, 33 aa, Artificial
  synthetic human C35/MAGE-6 polytope
KISGGPRISYPLGVRIVVEYAKISGGPRISYPL

SEQ ID NO: 1810 - protein, 20 aa, Artificial
  synthetic human C35/NY-ESO-1 polytope
GVRIVVEYASLLMWITQCFL

SEQ ID NO: 1811 - protein, 31 aa, Artificial
  synthetic human C35/NY-ESO-1 polytope
SLLMWITQCFLGVRIVVEYASLLMWITQCFL

SEQ ID NO: 1812 - protein, 18 aa, Artificial
  synthetic human C35/NY-ESO-1 polytope
GVRIVVEYASLLMWITQC

SEQ ID NO: 1813 - protein, 27 aa, Artificial
  synthetic human C35/NY-ESO-1 polytope
SLLMWITQCGVRIVVEYASLLMWITQC

SEQ ID NO: 1814 - protein, 18 aa, Artificial
  synthetic human C35/NY-ESO-1 polytope
GVRIVVEYAQLSLLMWIT

SEQ ID NO: 1815 - protein, 27 aa, Artificial
  synthetic human C35/NY-ESO-1 polytope
QLSLLMWITGVRIVVEYAQLSLLMWIT

SEQ ID NO: 1816 - protein, 38 aa, Artificial
  synthetic human C35/NY-ESO-1/MAGE-3 polytope
SLLMWITQCFLPVFGVRIVVEYATSYVKVLHHMVKISG

SEQ ID NO: 1817 - protein, 18 aa, Artificial
  synthetic human C35/MAGE-1 polytope
IVVEYAEPAEADPTGHSY

SEQ ID NO: 1818 - protein, 27 aa, Artificial
  synthetic human C35/MAGE-1 polytope
EADPTGHSYIVVEYAEPAEADPTGHSY

SEQ ID NO: 1819 - protein, 18 aa, Artificial
  synthetic human C35/MAGE-1 polytope
IVVEYAEPASAYGEPRKL

SEQ ID NO: 1820 - protein, 27 aa, Artificial
  synthetic human C35/MAGE-1 polytope
SAYGEPRKLIVVEYAEPASAYGEPRKL

SEQ ID NO: 1821 - protein, 18 aa, Artificial
  synthetic human C35/MAGE-3 polytope
IVVEYAEPAEVDPIGHLY

SEQ ID NO: 1822 - protein, 27 aa, Artificial
  synthetic human C35/MAGE-3 polytope
EVDPIGHLYIVVEYAEPAEVDPIGHLY

SEQ ID NO: 1823 - protein, 18 aa, Artificial
  synthetic human C35/MAGE-3 polytope
IVVEYAEPAFLWGPRALV

SEQ ID NO: 1824 - protein, 27 aa, Artificial
  synthetic human C35/MAGE-3 polytope
FLWGPRALVIVVEYAEPAFLWGPRALV

SEQ ID NO: 1825 - protein, 19 aa, Artificial
  synthetic human C35/MAGE-3 polytope
IVVEYAEPAMEVDPIGHLY

SEQ ID NO: 1826 - protein, 29 aa, Artificial
  synthetic human C35/MAGE-3 polytope
MEVDPIGHLYIVVEYAEPAMEVDPIGHLY

SEQ ID NO: 1827 - protein, 18 aa, Artificial
  synthetic human C35/BAGE polytope
IVVEYAEPAAARAVFLAL

SEQ ID NO: 1828 - protein, 27 aa, Artificial
  synthetic human C35/BAGE polytope
AARAVFLALIVVEYAEPAAARAVFLAL

SEQ ID NO: 1829 - protein, 17 aa, Artificial
  synthetic human C35/GAGE-1,2 polytope
IVVEYAEPAYRPRPRRY

SEQ ID NO: 1830 - protein, 25 aa, Artificial
  synthetic human C35/GAGE-1,2 polytope
YRPRPRRYIVVEYAEPAYRPRPRRY

SEQ ID NO: 1831 - protein, 19 aa, Artificial
  synthetic human C35/RAGE polytope
IVVEYAEPASPSSNRIRNT

SEQ ID NO: 1832 - protein, 29 aa, Artificial
  synthetic human C35/RAGE polytope
SPSSNRIRNTIVVEYAEPASPSSNRIRNT

SEQ ID NO: 1833 - protein, 19 aa, Artificial
  synthetic human C35/CDK4 polytope
IVVEYAEPAARDPHSGHFV

SEQ ID NO: 1834 - protein, 29 aa, Artificial
  synthetic human C35/CDK4 polytope
ARDPHSGHFVIVVEYAEPAARDPHSGHFV

SEQ ID NO: 1835 - protein, 18 aa, Artificial
  synthetic human C35/beta-catenin polytope
IVVEYAEPASYLDSGIHS

SEQ ID NO: 1836 - protein, 27 aa, Artificial
  synthetic human C35/beta-catenin polytope
SYLDSGIHSIVVEYAEPASYLDSGIHS

SEQ ID NO: 1837 - protein, 18 aa, Artificial
  synthetic human C35/tyrosinase polytope
IVVEYAEPAMLLAVLYCL

SEQ ID NO: 1838 - protein, 27 aa, Artificial
  synthetic human C35/tyrosinase polytope
MLLAVLYCLIVVEYAEPAMLLAVLYCL

SEQ ID NO: 1839 - protein, 18 aa, Artificial
  synthetic human C35/tyrosinase polytope
IVVEYAEPAAFLPWHRLF

SEQ ID NO: 1840 - protein, 27 aa, Artificial
  synthetic human C35/tyrosinase polytope
AFLPWHRLFIVVEYAEPAAFLPWHRLF

SEQ ID NO: 1841 - protein, 24 aa, Artificial
  synthetic human C35/tyrosinase polytope
IVVEYAEPAQNILLSNAPLGPQFP

SEQ ID NO: 1842 - protein, 39 aa, Artificial
  synthetic human C35/tyrosinase polytope
QNILLSNAPLGPQFPIVVEYAEPAQNILLSNAPLGPQFP

SEQ ID NO: 1843 - protein, 24 aa, Artificial
  synthetic human C35/tyrosinase polytope
IVVEYAEPADYSYLQDSDPDSFQD

SEQ ID NO: 1844 - protein, 39 aa, Artificial
  synthetic human C35/tyrosinase polytope
DYSYLQDSDPDSFQDIVVEYAEPADYSYLQDSDPDSFQD

SEQ ID NO: 1845 - protein, 19 aa, Artificial
  synthetic human C35/Melan-A polytope
IVVEYAEPAVILTVILGVL

SEQ ID NO: 1846 - protein, 27 aa, Artificial
  synthetic human C35/Melan-A polytope
ILTVILGVLIVVEYAEPAILTVILGVL

SEQ ID NO: 1847 - protein, 18 aa, Artificial
  synthetic human C35/gp100 polytope
IVVEYAEPAKTWGQYWQV

SEQ ID NO: 1848 - protein, 27 aa, Artificial
  synthetic human C35/gp100 polytope
KTWGQYWQVIVVEYAEPAKTWGQYWQV

SEQ ID NO: 1849 - protein, 18 aa, Artificial
  synthetic human C35/gp100 polytope
IVVEYAEPAITDQVPFSV

SEQ ID NO: 1850 - protein, 27 aa, Artificial
  synthetic human C35/gp100 polytope
ITDQVPFSVIVVEYAEPAITDQVPFSV

SEQ ID NO: 1851 - protein, 18 aa, Artificial
  synthetic human C35/gp100 polytope
IVVEYAEPAYLEPGPVTA

SEQ ID NO: 1852 - protein, 27 aa, Artificial
  synthetic human C35/gp100 polytope
YLEPGPVTAIVVEYAEPAYLEPGPVTA

SEQ ID NO: 1853 - protein, 19 aa, Artificial
  synthetic human C35/gp100 polytope
IVVEYAEPALLDGTATLRL

SEQ ID NO: 1854 - protein, 29 aa, Artificial
  synthetic human C35/gp100 polytope
LLDGTATLRLIVVEYAEPALLDGTATLRL

SEQ ID NO: 1855 - protein, 19 aa, Artificial
  synthetic human C35/gp100 polytope
IVVEYAEPAVLYRYGSFSV

SEQ ID NO: 1856 - protein, 29 aa, Artificial
  synthetic human C35/gp100 polytope
VLYRYGSFSVIVVEYAEPAVLYRYGSFSV

SEQ ID NO: 1857 - protein, 18 aa, Artificial
  synthetic human C35/PRAME polytope
IVVEYAEPALYVDSLFFL

SEQ ID NO: 1858 - protein, 27 aa, Artificial
  synthetic human C35/PRAME polytope
LYVDSLFFLIVVEYAEPALYVDSLFFL

SEQ ID NO: 1859 - protein, 21 aa, Artificial
  synthetic human C35/MAGE-6 polytope
IVVEYAEPAKISGGPRISYPL

SEQ ID NO: 1860 - protein, 33 aa, Artificial
  synthetic human C35/MAGE-6 polytope
KISGGPRISYPLIVVEYAEPAKISGGPRISYPL

SEQ ID NO: 1861 - protein, 20 aa, Artificial
  synthetic human C35/NY-ESO-1 polytope
IVVEYAEPASLLMWITQCFL

SEQ ID NO: 1862 - protein, 31 aa, Artificial
  synthetic human C35/NY-ESO-1 polytope
SLLMWITQCFLIVVEYAEPASLLMWITQCFL

SEQ ID NO: 1863 - protein, 18 aa, Artificial
  synthetic human C35/NY-ESO-1 polytope
IVVEYAEPASLLMWITQC

SEQ ID NO: 1864 - protein, 27 aa, Artificial
  synthetic human C35/NY-ESO-1 polytope
SLLMWITQCIVVEYAEPASLLMWITQC

SEQ ID NO: 1865 - protein, 18 aa, Artificial
  synthetic human C35/NY-ESO-1 polytope
IVVEYAEPAQLSLLMWIT

SEQ ID NO: 1866 - protein, 27 aa, Artificial
  synthetic human C35/NY-ESO-1 polytope
QLSLLMWITIVVEYAEPAQLSLLMWIT

SEQ ID NO: 1867 - protein, 38 aa, Artificial
  synthetic human C35/NY-ESO-1/MAGE-3 polytope
SLLMWITQCFLPVFIVVEYAEPATSYVKVLHHMVKISG

SEQ ID NO: 1868 - protein, 18 aa, Artificial
  synthetic human C35/MAGE-1 polytope
KITNSRPPAEADPTGHSY

SEQ ID NO: 1869 - protein, 27 aa, Artificial
  synthetic human C35/MAGE-1 polytope
EADPTGHSYKITNSRPPAEADPTGHSY

SEQ ID NO: 1870 - protein, 18 aa, Artificial
  synthetic human C35/MAGE-1 polytope
KITNSRPPASAYGEPRKL

SEQ ID NO: 1871 - protein, 27 aa, Artificial
  synthetic human C35/MAGE-1 polytope
SAYGEPRKLKITNSRPPASAYGEPRKL

SEQ ID NO: 1872 - protein, 18 aa, Artificial
  synthetic human C35/MAGE-3 polytope
KITNSRPPAEVDPIGHLY

SEQ ID NO: 1873 - protein, 27 aa, Artificial
  synthetic human C35/MAGE-3 polytope
EVDPIGHLYKITNSRPPAEVDPIGHLY

SEQ ID NO: 1874 - protein, 18 aa, Artificial
  synthetic human C35/MAGE-3 polytope
KITNSRPPAFLWGPRALV

SEQ ID NO: 1875 - protein, 27 aa, Artificial
  synthetic human C35/MAGE-3 polytope
FLWGPRALVKITNSRPPAFLWGPRALV

SEQ ID NO: 1876 - protein, 19 aa, Artificial
  synthetic human C35/MAGE-3 polytope
KITNSRPPAMEVDPIGHLY

SEQ ID NO: 1877 - protein, 29 aa, Artificial
  synthetic human C35/MAGE-3 polytope
MEVDPIGHLYKITNSRPPAMEVDPIGHLY

SEQ ID NO: 1878 - protein, 18 aa, Artificial
  synthetic human C35/BAGE polytope
KITNSRPPAAARAVFLAL

SEQ ID NO: 1879 - protein, 27 aa, Artificial
  synthetic human C35/BAGE polytope
AARAVFLALKITNSRPPAAARAVFLAL

SEQ ID NO: 1880 - protein, 17 aa, Artificial
  synthetic human C35/GAGE-1,2 polytope
KITNSRPPAYRPRPRRY

SEQ ID NO: 1881 - protein, 25 aa, Artificial
  synthetic human C35/GAGE-1,2 polytope
YRPRPRRYKITNSRPPAYRPRPRRY

SEQ ID NO: 1882 - protein, 19 aa, Artificial
  synthetic human C35/RAGE polytope
KITNSRPPASPSSNRIRNT

SEQ ID NO: 1883 - protein, 29 aa, Artificial
  synthetic human C35/RAGE polytope
SPSSNRIRNTKITNSRPPASPSSNRIRNT

SEQ ID NO: 1884 - protein, 19 aa, Artificial
  synthetic human C35/CDK4 polytope
KITNSRPPAARDPHSGHFV

SEQ ID NO: 1885 - protein, 29 aa, Artificial
  synthetic human C35/CDK4 polytope
ARDPHSGHFVKITNSRPPAARDPHSGHFV

SEQ ID NO: 1886 - protein, 18 aa, Artificial
  synthetic human C35/beta-catenin polytope
KITNSRPPASYLDSGIHS

SEQ ID NO: 1887 - protein, 27 aa, Artificial
  synthetic human C35/beta-catenin polytope
SYLDSGIHSKITNSRPPASYLDSGIHS

SEQ ID NO: 1888 - protein, 18 aa, Artificial
  synthetic human C35/tyrosinase
KITNSRPPAMLLAVLYCL

SEQ ID NO: 1889 - protein, 27 aa, Artificial
  synthetic human C35/tyrosinase
MLLAVLYCLKITNSRPPAMLLAVLYCL

SEQ ID NO: 1890 - protein, 18 aa, Artificial
  synthetic human C35/tyrosinase
KITNSRPPAAFLPWHRLF

SEQ ID NO: 1891 - protein, 27 aa, Artificial
  synthetic human C35/tyrosinase
AFLPWHRLFKITNSRPPAAFLPWHRLF

SEQ ID NO: 1892 - protein, 24 aa, Artificial
  synthetic human C35/tyrosinase
KITNSRPPAQNILLSNAPLGPQFP

SEQ ID NO: 1893 - protein, 39 aa, Artificial
  synthetic human C35/tyrosinase
QNILLSNAPLGPQFPKITNSRPPAQNILLSNAPLGPQFP

SEQ ID NO: 1894 - protein, 24 aa, Artificial
  synthetic human C35/tyrosinase
KITNSRPPADYSYLQDSDPDSFQD

SEQ ID NO: 1895 - protein, 39 aa, Artificial
  synthetic human C35/tyrosinase
DYSYLQDSDPDSFQDKITNSRPPADYSYLQDSDPDSFQD

SEQ ID NO: 1896 - protein, 18 aa, Artificial
  synthetic human C35/Melan-A polytope
KITNSRPPAILTVILGVL

SEQ ID NO: 1897 - protein, 27 aa, Artificial
  synthetic human C35/Melan-A polytope
ILTVILGVLKITNSRPPAILTVILGVL

SEQ ID NO: 1898 - protein, 18 aa, Artificial
  synthetic human C35/gp100 polytope
KITNSRPPAKTWGQYWQV

SEQ ID NO: 1899 - protein, 27 aa, Artificial
  synthetic human C35/gp100 polytope
KTWGQYWQVKITNSRPPAKTWGQYWQV

SEQ ID NO: 1900 - protein, 18 aa, Artificial
  synthetic human C35/gp100 polytope
KITNSRPPAITDQVPFSV

SEQ ID NO: 1901 - protein, 27 aa, Artificial
  synthetic human C35/gp100 polytope
ITDQVPFSVKITNSRPPAITDQVPFSV

SEQ ID NO: 1902 - protein, 18 aa, Artificial
  synthetic human C35/gp100 polytope
KITNSRPPAYLEPGPVTA

SEQ ID NO: 1903 - protein, 27 aa, Artificial
  synthetic human C35/gp100 polytope
YLEPGPVTAKITNSRPPAYLEPGPVTA

SEQ ID NO: 1904 - protein, 19 aa, Artificial
  synthetic human C35/gp100 polytope
KITNSRPPALLDGTATLRL

SEQ ID NO: 1905 - protein, 29 aa, Artificial
  synthetic human C35/gp100 polytope
LLDGTATLRLKITNSRPPALLDGTATLRL

SEQ ID NO: 1906 - protein, 19 aa, Artificial
  synthetic human C35/gp100 polytope
KITNSRPPAVLYRYGSFSV

SEQ ID NO: 1907 - protein, 29 aa, Artificial
  synthetic human C35/gp100 polytope
VLYRYGSFSVKITNSRPPAVLYRYGSFSV

SEQ ID NO: 1908 - protein, 18 aa, Artificial
  synthetic human C35/PRAME polytope
KITNSRPPALYVDSLFFL

SEQ ID NO: 1909 - protein, 27 aa, Artificial
  synthetic human C35/PRAME polytope
LYVDSLFFLKITNSRPPALYVDSLFFL

SEQ ID NO: 1910 - protein, 21 aa, Artificial
  synthetic human C35/MAGE-6 polytope
KITNSRPPAKISGGPRISYPL

SEQ ID NO: 1911 - protein, 33 aa, Artificial
  synthetic human C35/MAGE-6 polytope
KISGGPRISYPLKITNSRPPAKISGGPRISYPL

SEQ ID NO: 1912 - protein, 20 aa, Artificial
  synthetic human C35/NY-ESO-1 polytope
KITNSRPPASLLMWITQCFL

SEQ ID NO: 1913 - protein, 31 aa, Artificial
  synthetic human C35/NY-ESO-1 polytope
SLLMWITQCFLKITNSRPPASLLMWITQCFL

SEQ ID NO: 1914 - protein, 18 aa, Artificial
  synthetic human C35/NY-ESO-1 polytope
KITNSRPPASLLMWITQC

SEQ ID NO: 1915 - protein, 27 aa, Artificial
  synthetic human C35/NY-ESO-1 polytope
SLLMWITQCKITNSRPPASLLMWITQC

SEQ ID NO: 1916 - protein, 18 aa, Artificial
  synthetic human C35/NY-ESO-1 polytope
KITNSRPPAQLSLLMWIT

SEQ ID NO: 1917 - protein, 27 aa, Artificial
  synthetic human C35/NY-ESO-1 polytope
QLSLLMWITKITNSRPPAQLSLLMWIT

SEQ ID NO: 1918 - protein, 38 aa, Artificial
  synthetic human C35/NY-ESO-1/MAGE-3 polytope
SLLMWITQCFLPVFKITNSRPPATSYVKVLHHMVKISG

SEQ ID NO: 1919 - protein, 310 aa, Artificial
  synthetic human C35/HSV-1 VP22 polypeptide
SVAPPPEEVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1920 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVESVAPPPEEVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1921 - protein, 21 aa, Artificial
  synthetic human C35/MST from Kaposi FGF polypeptide
SVAPPPEEVAAVLLPVLLAAP

SEQ ID NO: 1922 - protein, 33 aa, Artificial
  synthetic human C35/MST from Kaposi FGF polypeptide
AAVLLPVLLAAPSVAPPPEEVAAVLLPVLLAAP

SEQ ID NO: 1923 - protein, 310 aa, Artificial
  synthetic human C35/HSV-1 VP22 polypeptide
SGVRIVVEYMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1924 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVESGVRIVVEYMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1925 - protein, 21 aa, Artificial
  synthetic human C35/MST from Kaposi FGF polypeptide
SGVRIVVEYAAVLLPVLLAAP

SEQ ID NO: 1926 - protein, 33 aa, Artificial
  synthetic human C35/MST from Kaposi FGF polypeptide
AAVLLPVLLAAPSGVRIVVEYAAVLLPVLLAAP

SEQ ID NO: 1927 - protein, 310 aa, Artificial
  synthetic human C35/HSV-1 VP22 polypeptide
GVRIVVEYCMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1928 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEGVRIVVEYCMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1929 - protein, 21 aa, Artificial
  synthetic human C35/MST from Kaposi FGF polypeptide
GVRIVVEYCAAVLLPVLLAAP

SEQ ID NO: 1930 - protein, 33 aa, Artificial
  synthetic human C35/MST from Kaposi FGF polypeptide
AAVLLPVLLAAPGVRIVVEYCAAVLLPVLLAAP

SEQ ID NO: 1931 - protein, 310 aa, Artificial
  synthetic human C35/HSV-1 VP22 polypeptide
IVVEYCEPCMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1932 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEIVVEYCEPCMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1933 - protein, 21 aa, Artificial
  synthetic human C35/MST from Kaposi FGF polypeptide
IVVEYCEPCAAVLLPVLLAAP

SEQ ID NO: 1934 - protein, 33 aa, Artificial
  synthetic human C35/MST from Kaposi FGF polypeptide
AAVLLPVLLAAPIVVEYCEPCAAVLLPVLLAAP

SEQ ID NO: 1935 - protein, 310 aa, Artificial
  synthetic human C35/HSV-1 VP22 polypeptide
TYLELASAVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1936 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVETYLELASAVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1937 - protein, 21 aa, Artificial
  synthetic human C35/MST from Kaposi FGF polypeptide
TYLELASAVAAVLLPVLLAAP

SEQ ID NO: 1938 - protein, 33 aa, Artificial
  synthetic human C35/MST from Kaposi FGF polypeptide
AAVLLPVLLAAPTYLELASAVAAVLLPVLLAAP

SEQ ID NO: 1939 - protein, 310 aa, Artificial
  synthetic human C35/HSV-1 VP22 polypeptide
GTGAFEIEIMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1940 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEGTGAFEIEIMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1941 - protein, 21 aa, Artificial
  synthetic human C35/MST from Kaposi FGF polypeptide
GTGAFEIEIAAVLLPVLLAAP

SEQ ID NO: 1942 - protein, 33 aa, Artificial
  synthetic human C35/MST from Kaposi FGF polypeptide
AAVLLPVLLAAPGTGAFEIEIAAVLLPVLLAAP

SEQ ID NO: 1943 - protein, 310 aa, Artificial
  synthetic human C35/HSV-1 VP22 polypeptide
FEIEINGQLMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1944 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEFEIEINGQLMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1945 - protein, 21 aa, Artificial
  synthetic human C35/MST from Kaposi FGF polypeptide
FEIEINGQLAAVLLPVLLAAP

SEQ ID NO: 1946 - protein, 33 aa, Artificial
  synthetic human C35/MST from Kaposi FGF polypeptide
AAVLLPVLLAAPFEIEINGQLAAVLLPVLLAAP

SEQ ID NO: 1947 - protein, 310 aa, Artificial
  synthetic human C35/HSV-1 VP22 polypeptide
IEINGQLVFMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1948 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEIEINGQLVFMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1949 - protein, 21 aa, Artificial
  synthetic human C35/MST from Kaposi FGF polypeptide
IEINGQLVFAAVLLPVLLAAP

SEQ ID NO: 1950 - protein, 33 aa, Artificial
  synthetic human C35/MST from Kaposi FGF polypeptide
AAVLLPVLLAAPIEINGQLVFAAVLLPVLLAAP

SEQ ID NO: 1951 - protein, 310 aa, Artificial
  synthetic human C35/HSV-1 VP22 polypeptide
KLENGGFPYMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1952 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEKLENGGFPYMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1953 - protein, 21 aa, Artificial
  synthetic human C35/MST from Kaposi FGF polypeptide
KLENGGFPYAAVLLPVLLAAP

SEQ ID NO: 1954 - protein, 33 aa, Artificial
  synthetic human C35/MST from Kaposi FGF polypeptide
AAVLLPVLLAAPKLENGGFPYAAVLLPVLLAAP

SEQ ID NO: 1955 - protein, 316 aa, Artificial
  synthetic human C35/HSV-1 VP22 polypeptide
QLVFSKLENGGFPYEMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1956 - protein, 617 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEQLVFSKLENGGFPYEMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1957 - protein, 27 aa, Artificial
  synthetic human C35/MST from Kaposi FGF polypeptide
QLVFSKLENGGFPYEAAVLLPVLLAAP

SEQ ID NO: 1958 - protein, 39 aa, Artificial
  synthetic human C35/MST from Kaposi FGF polypeptide
AAVLLPVLLAAPQLVFSKLENGGFPYEAAVLLPVLLAAP

SEQ ID NO: 1959 - protein, 310 aa, Artificial
  synthetic human C35/HSV-1 VP22 polypeptide
GGFPYEKDLMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1960 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEGGFPYEKDLMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1961 - protein, 21 aa, Artificial
  synthetic human C35/MST from Kaposi FGF polypeptide
GGFPYEKDLAAVLLPVLLAAP

SEQ ID NO: 1962 - protein, 33 aa, Artificial
  synthetic human C35/MST from Kaposi FGF polypeptide
AAVLLPVLLAAPGGFPYEKDLAAVLLPVLLAAP

SEQ ID NO: 1963 - protein, 310 aa, Artificial
  synthetic human C35/HSV-1 VP22 polypeptide
KITNSRPPCMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1964 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEKITNSRPPCMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1965 - protein, 21 aa, Artificial
  synthetic human C35/MST from Kaposi FGF polypeptide
KITNSRPPCAAVLLPVLLAAP

SEQ ID NO: 1966 - protein, 33 aa, Artificial
  synthetic human C35/MST from Kaposi FGF polypeptide
AAVLLPVLLAAPKITNSRPPCAAVLLPVLLAAP

SEQ ID NO: 1967 - protein, 311 aa, Artificial
  synthetic human C35/HSV-1 VP22 polypeptide
KITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1968 - protein, 612 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1969 - protein, 22 aa, Artificial
  synthetic human C35/MST from Kaposi FGF polypeptide
KITNSRPPCVAAVLLPVLLAAP

SEQ ID NO: 1970 - protein, 34 aa, Artificial
  synthetic human C35/MST from Kaposi FGF polypeptide
AAVLLPVLLAAPKITNSRPPCVAAVLLPVLLAAP

SEQ ID NO: 1971 - protein, 310 aa, Artificial
  synthetic human C35/HSV-1 VP22 polypeptide
ITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1972 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1973 - protein, 21 aa, Artificial
  synthetic human C35/MST from Kaposi FGF polypeptide
ITNSRPPCVAAVLLPVLLAAP

SEQ ID NO: 1974 - protein, 33 aa, Artificial
  synthetic human C35/MST from Kaposi FGF polypeptide
AAVLLPVLLAAPITNSRPPCVAAVLLPVLLAAP

SEQ ID NO: 1975 - protein, 314 aa, Artificial
  synthetic human C35/HSV-1 VP22 polypeptide
TLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1976 - protein, 615 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1977 - protein, 25 aa, Artificial
  synthetic human C35/MST from Kaposi FGF polypeptide
TLEKITNSRPPCVAAVLLPVLLAAP

SEQ ID NO: 1978 - protein, 37 aa, Artificial
  synthetic human C35/MST from Kaposi FGF polypeptide
AAVLLPVLLAAPTLEKITNSRPPCVAAVLLPVLLAAP

SEQ ID NO: 1979 - protein, 322 aa, Artificial
  synthetic human C35/HSV-1 VP22 polypeptide
IRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1980 - protein, 623 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1981 - protein, 33 aa, Artificial
  synthetic human C35/MST from Kaposi FGF polypeptide
IRRASNGETLEKITNSRPPCVAAVLLPVLLAAP

SEQ ID NO: 1982 - protein, 45 aa, Artificial
  synthetic human C35/MST from Kaposi FGF polypeptide
AAVLLPVLLAAPIRRASNGETLEKITNSRPPCVAAVLLPVLLAAP

SEQ ID NO: 1983 - protein, 327 aa, Artificial
  synthetic human C35/HSV-1 VP22 polypeptide
DLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1984 - protein, 628 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEDLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1985 - protein, 38 aa, Artificial
  synthetic human C35/MST from Kaposi FGF polypeptide
DLIEAIRRASNGETLEKITNSRPPCVAAVLLPVLLAAP

SEQ ID NO: 1986 - protein, 50 aa, Artificial
  synthetic human C35/MST from Kaposi FGF polypeptide
AAVLLPVLLAAPDLIEAIRRASNGETLEKITNSRPPCVAAVLLPVLLAAP

SEQ ID NO: 1987 - protein, 331 aa, Artificial
  synthetic human C35/HSV-1 VP22 polypeptide
PYEKDLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1988 - protein, 632 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEPYEKDLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1989 - protein, 42 aa, Artificial
  synthetic human C35/MST from Kaposi FGF polypeptide
PYEKDLIEAIRRASNGETLEKITNSRPPCVAAVLLPVLLAAP

SEQ ID NO: 1990 - protein, 54 aa, Artificial
  synthetic human C35/MST from Kaposi FGF polypeptide
AAVLLPVLLAAPPYEKDLIEAIRRASNGETLEKITNSRPPCVAAVLLPVLLAAP

SEQ ID NO: 1991 - protein, 338 aa, Artificial
  synthetic human C35/HSV-1 VP22 polypeptide
KLENGGFPYEKDLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1992 - protein, 639 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEKLENGGFPYEKDLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1993 - protein, 49 aa, Artificial
  synthetic human C35/MST from Kaposi FGF polypeptide
KLENGGFPYEKDLIEAIRRASNGETLEKITNSRPPCVAAVLLPVLLAAP

SEQ ID NO: 1994 - protein, 49 aa, Artificial
  synthetic human C35/MST from Kaposi FGF polypeptide
AAVLLPVLLAAPKLENGGFPYEKDLIEAIRRASNGETLEKITNSRPPCV

SEQ ID NO: 1995 - protein, 343 aa, Artificial
  synthetic human C35/HSV-1 VP22 polypeptide
QLVFSKLENGGFPYEKDLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1996 - protein, 644 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEQLVFSKLENGGFPYEKDLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 1997 - protein, 54 aa, Artificial
  synthetic human C35/MST from Kaposi FGF polypeptide
QLVFSKLENGGFPYEKDLIEAIRRASNGETLEKITNSRPPCVAAVLLPVLLAAP

SEQ ID NO: 1998 - protein, 66 aa, Artificial
  synthetic human C35/MST from Kaposi FGF polypeptide
AAVLLPVLLAAPQLVFSKLENGGFPYEKDLIEAIRRASNGETLEKITNSRPPCVAAVLLPVLLAAP

SEQ ID NO: 1999 - protein, 350 aa, Artificial
  synthetic human C35/HSV-1 VP22 polypeptide
FEIEINGQLVFSKLENGGFPYEKDLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2000 - protein, 651 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEFEIEINGQLVFSKLENGGFPYEKDLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2001 - protein, 61 aa, Artificial
  synthetic human C35/MST from Kaposi FGF polypeptide
FEIEINGQLVFSKLENGGFPYEKDLIEAIRRASNGETLEKITNSRPPCVAAVLLPVLLAAP

SEQ ID NO: 2002 - protein, 73 aa, Artificial
  synthetic human C35/MST from Kaposi FGF polypeptide
AAVLLPVLLAAPFEIEINGQLVFSKLENGGFPYEKDLIEAIRRASNGETLEKITNSRPPCVAAVLLPVLLAAP

SEQ ID NO: 2003 - protein, 356 aa, Artificial
  synthetic human C35/HSV-1 VP22 polypeptide
LGGTGAFEIEINGQLVFSKLENGGFPYEKDLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2004 - protein, 657 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVELGGTGAFEIEINGQLVFSKLENGGFPYEKDLIEAIRRASNGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2005 - protein, 67 aa, Artificial
  synthetic human C35/MST from Kaposi FGF polypeptide
LGGTGAFEIEINGQLVFSKLENGGFPYEKDLIEAIRRASNGETLEKITNSRPPCVAAVLLPVLLAAP

SEQ ID NO: 2006 - protein, 79 aa, Artificial
  synthetic human C35/MST from Kaposi FGF polypeptide
AAVLLPVLLAAPLGGTGAFEIEINGQLVFSKLENGGFPYEKDLIEAIRRASNGETLEKITNSRPPCVAAVLLPVLLAAP

SEQ ID NO: 2007 - protein, 316 aa, Artificial
  synthetic human C35/HSV-1 VP22 polypeptide
GETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2008 - protein, 617 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEGETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2009 - protein, 27 aa, Artificial
  synthetic human C35/MST from Kaposi FGF polypeptide
GETLEKITNSRPPCVAAVLLPVLLAAP

SEQ ID NO: 2010 - protein, 39 aa, Artificial
  synthetic human C35/MST from Kaposi FGF polypeptide
AAVLLPVLLAAPGETLEKITNSRPPCVAAVLLPVLLAAP

SEQ ID NO: 2011 - protein, 315 aa, Artificial
  synthetic human C35/HSV-1 VP22 polypeptide
ETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2012 - protein, 616 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEETLEKITNSRPPCVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2013 - protein, 26 aa, Artificial
  synthetic human C35/MST from Kaposi FGF polypeptide
ETLEKITNSRPPCVAAVLLPVLLAAP

SEQ ID NO: 2014 - protein, 38 aa, Artificial
  synthetic human C35/MST from Kaposi FGF polypeptide
AAVLLPVLLAAPETLEKITNSRPPCVAAVLLPVLLAAP

SEQ ID NO: 2015 - protein, 310 aa, Artificial
  synthetic human C35/HSV-1 VP22 polypeptide
KLENGGFPVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2016 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEKLENGGFPVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2017 - protein, 21 aa, Artificial
  synthetic human C35/MST from Kaposi FGF polypeptide
KLENGGFPVAAVLLPVLLAAP

SEQ ID NO: 2018 - protein, 33 aa, Artificial
  synthetic human C35/MST from Kaposi FGF polypeptide
AAVLLPVLLAAPKLENGGFPVAAVLLPVLLAAP

SEQ ID NO: 2019 - protein, 310 aa, Artificial
  synthetic human C35/HSV-1 VP22 polypeptide
KITNSRPPLMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2020 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEKITNSRPPLMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2021 - protein, 21 aa, Artificial
  synthetic human C35/MST from Kaposi FGF polypeptide
KITNSRPPLAAVLLPVLLAAP

SEQ ID NO: 2022 - protein, 33 aa, Artificial
  synthetic human C35/MST from Kaposi FGF polypeptide
AAVLLPVLLAAPKITNSRPPLAAVLLPVLLAAP

SEQ ID NO: 2023 - protein, 310 aa, Artificial
  synthetic human C35/HSV-1 VP22 polypeptide
ILNSRPPAVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2024 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEILNSRPPAVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2025 - protein, 21 aa, Artificial
  synthetic human C35/MST from Kaposi FGF polypeptide
ILNSRPPAVAAVLLPVLLAAP

SEQ ID NO: 2026 - protein, 33 aa, Artificial
  synthetic human C35/MST from Kaposi FGF polypeptide
AAVLLPVLLAAPILNSRPPAVAAVLLPVLLAAP

SEQ ID NO: 2027 - protein, 310 aa, Artificial
  synthetic human C35/HSV-1 VP22 polypeptide
IMNSRPPAVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2028 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEIMNSRPPAVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2029 - protein, 21 aa, Artificial
  synthetic human C35/MST from Kaposi FGF polypeptide
IMNSRPPAVAAVLLPVLLAAP

SEQ ID NO: 2030 - protein, 33 aa, Artificial
  synthetic human C35/MST from Kaposi FGF polypeptide
AAVLLPVLLAAPIMNSRPPAVAAVLLPVLLAAP

SEQ ID NO: 2031 - protein, 310 aa, Artificial
  synthetic human C35/HSV-1 VP22 polypeptide
ITNSRPPSVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2032 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEITNSRPPSVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2033 - protein, 21 aa, Artificial
  synthetic human C35/MST from Kaposi FGF polypeptide
ITNSRPPSVAAVLLPVLLAAP

SEQ ID NO: 2034 - protein, 33 aa, Artificial
  synthetic human C35/MST from Kaposi FGF polypeptide
AAVLLPVLLAAPITNSRPPSVAAVLLPVLLAAP

SEQ ID NO: 2035 - protein, 311 aa, Artificial
  synthetic human C35/HSV-1 VP22 polypeptide
KITNSRPPSVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2036 - protein, 612 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEKITNSRPPSVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2037 - protein, 22 aa, Artificial
  synthetic human C35/MST from Kaposi FGF polypeptide
KITNSRPPSVAAVLLPVLLAAP

SEQ ID NO: 2038 - protein, 34 aa, Artificial
  synthetic human C35/MST from Kaposi FGF polypeptide
AAVLLPVLLAAPKITNSRPPSVAAVLLPVLLAAP

SEQ ID NO: 2039 - protein, 310 aa, Artificial
  synthetic human C35/HSV-1 VP22 polypeptide
GVRIVVEYAMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2040 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEGVRIVVEYAMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2041 - protein, 21 aa, Artificial
  synthetic human C35/MST from Kaposi FGF polypeptide
GVRIVVEYAAAVLLPVLLAAP

SEQ ID NO: 2042 - protein, 33 aa, Artificial
  synthetic human C35/MST from Kaposi FGF polypeptide
AAVLLPVLLAAPGVRIVVEYAAAVLLPVLLAAP

SEQ ID NO: 2043 - protein, 310 aa, Artificial
  synthetic human C35/HSV-1 VP22 polypeptide
IVVEYAEPAMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2044 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEIVVEYAEPAMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2045 - protein, 21 aa, Artificial
  synthetic human C35/MST from Kaposi FGF polypeptide
IVVEYAEPAAAVLLPVLLAAP

SEQ ID NO: 2046 - protein, 33 aa, Artificial
  synthetic human C35/MST from Kaposi FGF polypeptide
AAVLLPVLLAAPIVVEYAEPAAAVLLPVLLAAP

SEQ ID NO: 2047 - protein, 310 aa, Artificial
  synthetic human C35/HSV-1 VP22 polypeptide
KITNSRPPAMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2048 - protein, 611 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEKITNSRPPAMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2049 - protein, 21 aa, Artificial
  synthetic human C35/MST from Kaposi FGF polypeptide
KITNSRPPAAAVLLPVLLAAP

SEQ ID NO: 2050 - protein, 33 aa, Artificial
  synthetic human C35/MST from Kaposi FGF polypeptide
AAVLLPVLLAAPKITNSRPPAAAVLLPVLLAAP

SEQ ID NO: 2051 - protein, 311 aa, Artificial
  synthetic human C35/HSV-1 VP22 polypeptide
KITNSRPPAVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2052 - protein, 612 aa, Artificial
  synthetic human C35/HSV-1 VP22 polypeptide
MTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVEKITNSRPPAVMTSRRSVKSGPREVPRDEYEDLYYTPSSGMASPDSPPDTSRRGALQTRSRQRGEVRFVQYDESDYALYGGSSSEDDEHPEVPRTRRPVSGAVLSGPGPARAPPPPAGSGGAGRTPTTAPRAPRTQRVATKAPAAPAAETTRGRKSAQPESAALPDAPASTAPTRSKTPAQGLARKLHFSTAPPNPDAPWTPRVAGFNKRVFCAAVGRLAAMHARMAAVQLWDMSRPRTDEDLNELLGITTIRVTVCEGKNLLQRANELVNPDVVQDVDAATATRGRSAASRPTERPRAPARSASRPRRPVE

SEQ ID NO: 2053 - protein, 22 aa, Artificial
  synthetic human C35/MST from Kaposi FGF polypeptide
KITNSRPPAVAAVLLPVLLAAP

SEQ ID NO: 2054 - protein, 34 aa, Artificial
  synthetic human C35/MST from Kaposi FGF polypeptide
AAVLLPVLLAAPKITNSRPPAVAAVLLPVLLAAP

SEQ ID NO: 2055 - protein, 21 aa, Plasmodium falciparum
DIEKKIAKMEKASSVFNVVNS

SEQ ID NO: 2056 - protein, 14 aa, Artificial
  Synthesized Tetanus toxoid antigen
QYIKANSKFIGITE

SEQ ID NO: 2057 - protein, 16 aa, Streptococcus sp.
GAVDSILGGVATYGAA

SEQ ID NO: 2058 - protein, 13 aa, Artificial
  from PADRE family of peptides
  misc_feature: X is either a cyclohexylalanine, phenylalanine or a tyrosine Z is either a tryptophan, tyrosine, histidine, or asparagine a is either a D-alanine or L-alanine
  misc_feature (3)..(3): Xaa can be any naturally occurring amino acid
AKXVAAZTLKAAA

SEQ ID NO: 2059 - protein, 9 aa, Artificial
  synthetic human C35 peptide
STEPGQTSV

SEQ ID NO: 2060 - protein, 9 aa, Artificial
  synthetic human C35 peptide
STEPGQISY

SEQ ID NO: 2061 - protein, 9 aa, Artificial
  synthetic human C35 peptide
GTEPSRLGY

SEQ ID NO: 2062 - protein, 9 aa, Artificial
  synthetic human C35 peptide
FLIEINWYL

SEQ ID NO: 2063 - protein, 10 aa, Artificial
  synthetic human C35 peptide
FLYEKDLIEA

SEQ ID NO: 2064 - protein, 10 aa, Artificial
  synthetic human C35 peptide
FLYEKDLIEV

SEQ ID NO: 2065 - protein, 9 aa, Artificial
  synthetic human C35 peptide
GVFPYEKDL

SEQ ID NO: 2066 - protein, 10 aa, Artificial
  synthetic human C35 peptide
CVEFATYLEL

SEQ ID NO: 2067 - protein, 10 aa, Artificial
  synthetic human C35 peptide
FVYEKDLIEA

SEQ ID NO: 2068 - protein, 9 aa, Artificial
  synthetic human C35 peptide
QYPGIEIEL

SEQ ID NO: 2069 - protein, 10 aa, Artificial
  synthetic human C35 peptide
IYGQLVFSKL

SEQ ID NO: 2070 - protein, 9 aa, Artificial
  synthetic human C35 peptide
KLENGGFPK

SEQ ID NO: 2071 - protein, 9 aa, Artificial
  synthetic human C35 peptide
ILGQLVFSK

SEQ ID NO: 2072 - protein, 10 aa, Artificial
  synthetic human C35 peptide
LLNGGFPYEK

SEQ ID NO: 2073 - protein, 9 aa, Artificial
  synthetic human C35 peptide
IVGQLVFSK

SEQ ID NO: 2074 - protein, 10 aa, Artificial
  synthetic human C35 peptide
LVNGGFPYEK

SEQ ID NO: 2075 - protein, 9 aa, Artificial
  synthetic human C35 peptide
KILIEAIRR

SEQ ID NO: 2076 - protein, 9 aa, Artificial
  synthetic human C35 peptide
YVGIEIESR

SEQ ID NO: 2077 - protein, 9 aa, Artificial
  synthetic human C35 peptide
EVVEPGSGR

SEQ ID NO: 2078 - protein, 9 aa, Artificial
  synthetic human C35 peptide
SRLGGTGAL

SEQ ID NO: 2079 - protein, 10 aa, Artificial
  synthetic human C35 peptide
ERITNSRPPL

SEQ ID NO: 2080 - protein, 9 aa, Artificial
  synthetic human C35 peptide
EEVEPGSGL

SEQ ID NO: 2081 - protein, 10 aa, Artificial
  synthetic human C35 peptide
IEIESRLGGL

SEQ ID NO: 2082 - protein, 9 aa, Artificial
  synthetic human C35 peptide
VEPGSGVRL

SEQ ID NO: 2083 - protein, 10 aa, Artificial
  synthetic human C35 peptide
FEIEINGQLL

SEQ ID NO: 2084 - protein, 9 aa, Artificial
  synthetic human C35 peptide
FEATYLELV

SEQ ID NO: 2085 - protein, 10 aa, Artificial
  synthetic human C35 peptide
KELIEAIRRV

SEQ ID NO: 2086 - protein, 9 aa, Artificial
  synthetic human C35 peptide
EQCGFEATY

SEQ ID NO: 2087 - protein, 10 aa, Artificial
  synthetic human C35 peptide
EQRLGGTGAF

SEQ ID NO: 2088 - protein, 10 aa, Artificial
  synthetic human C35 peptide
GQGVRIVVEY

SEQ ID NO: 2089 - protein, 9 aa, Artificial
  synthetic human C35 peptide
NPRPPCVIL

SEQ ID NO: 2090 - protein, 10 aa, Artificial
  synthetic human C35 peptide
EPGSGVRIVL

SEQ ID NO: 2091 - protein, 9 aa, Artificial
  synthetic human C35 peptide
ETLEKITNL

SEQ ID NO: 2092 - protein, 8 aa, Artificial
  synthetic human C35 peptide
EAIRRASL

SEQ ID NO: 2093 - protein, 10 aa, Artificial
  synthetic human C35 peptide
IARASNGETL

SEQ ID NO: 2094 - protein, 9 aa, Artificial
  synthetic human C35 peptide
RRASNGETF

SEQ ID NO: 2095 - protein, 10 aa, Artificial
  synthetic human C35 peptide
VRIVVEYCEY

SEQ ID NO: 2096 - protein, 9 aa, Artificial
  synthetic human C35 peptide
IRRASNGEL

SEQ ID NO: 2097 - protein, 10 aa, Artificial
  synthetic human C35 peptide
RRASNGETLL

SEQ ID NO: 2098 - protein, 9 aa, Artificial
  synthetic human C35 peptide
FPKLENGGM

SEQ ID NO: 2099 - protein, 10 aa, Artificial
  synthetic human C35 peptide
FPYEKDLIEM

SEQ ID NO: 2100 - protein, 9 aa, Artificial
  synthetic human C35 peptide
FDIEINGQL

SEQ ID NO: 2101 - protein, 10 aa, Artificial
  synthetic human C35 peptide
FDIEINGQLI

SEQ ID NO: 2102 - protein, 9 aa, Artificial
  synthetic human C35 peptide
GHEATYLEL

SEQ ID NO: 2103 - protein, 10 aa, Artificial
  synthetic human C35 peptide
AHEIEINGQL

SEQ ID NO: 2104 - protein, 9 aa, Artificial
  synthetic human C35 peptide
RHASNGETL

SEQ ID NO: 2105 - protein, 10 aa, Artificial
  synthetic human C35 peptide
CHFEATYLEL

SEQ ID NO: 2106 - protein, 9 aa, Artificial
  synthetic human C35 peptide
NKQLVFSKL

SEQ ID NO: 2107 - protein, 9 aa, Artificial
  synthetic human C35 peptide
IEINGQLVY

SEQ ID NO: 2108 - protein, 10 aa, Artificial
  synthetic human C35 peptide
IEIESRLGGY

SEQ ID NO: 2109 - protein, 9 aa, Artificial
  synthetic human C35 peptide
LPGTGAFEI

SEQ ID NO: 2110 - protein, 10 aa, Artificial
  synthetic human C35 peptide
SPVKEQYPGI

SEQ ID NO: 2111 - protein, 9 aa, Artificial
  synthetic human C35 peptide
GPFPYEKDI

SEQ ID NO: 2112 - protein, 10 aa, Artificial
  synthetic human C35 peptide
SPVKEQYPGI

SEQ ID NO: 2113 - protein, 9 aa, Artificial
  synthetic human C35 peptide
LAFTGAFEI

SEQ ID NO: 2114 - protein, 10 aa, Artificial
  synthetic human C35 peptide
EAGSGVRIVV

SEQ ID NO: 2115 - protein, 9 aa, Artificial
  synthetic human C35 peptide
LQINGQLVI

SEQ ID NO: 2116 - protein, 10 aa, Artificial
  synthetic human C35 peptide
VQPGSGVRIV

SEQ ID NO: 2117 - protein, 9 aa, Artificial
  synthetic human C35 peptide
FSKLENGGW

SEQ ID NO: 2118 - protein, 10 aa, Artificial
  synthetic human C35 peptide
GSGVRIVVEW

SEQ ID NO: 2119 - protein, 10 aa, Artificial
  synthetic human C35 peptide
SAVKEQYPGL

SEQ ID NO: 2120 - protein, 9 aa, Artificial
  synthetic human C35 peptide
EFCGFEATL

SEQ ID NO: 2121 - protein, 10 aa, Artificial
  synthetic human C35 peptide
VFSKLENGGL

SEQ ID NO: 2122 - protein, 8 aa, Chicken
SIINFEKL

SEQ ID NO: 2123 - skipped

SEQ ID NO: 2124 - DNA, 20 bp, Artificial
  L3.Fl.S primer
cggcgagatgtctcacagga

SEQ ID NO: 2125 - DNA, 20 bp, Artificial
  L3.Fl.AS primer
accccaccatctgcacaaag

SEQ ID NO: 2126 - protein, 17 aa, Homo sapiens
GCGATGACGGGGGAGCC

SEQ ID NO: 2127 - DNA, 23 bp, Homo sapiens
ccacggaatcttctattctttct

SEQ ID NO: 2128 - protein, 9 aa, Homo sapiens
GRAFVTIGK

SEQ ID NO: 2129 - protein, 10 aa, Homo sapiens
KLGEFYNQMM

SEQ ID NO: 2130 - protein, 11 aa, Artificial
  synthetic human cysteinylated C35 peptide
KITNSRPPCCV

SEQ ID NO: 2131 - protein, 27 aa, Artificial
  synthetic human C35/tyrosinase polytope
AFLPWHRLFGVRIVVEYAAFLPWHRLF

SEQ ID NO: 2132 - protein, 24 aa, Artificial
  synthetic human C35/tyrosinase polytope
GVRIVVEYAQNILLSNAPLGPQFP

SEQ ID NO: 2133 - protein, 39 aa, Artificial
  synthetic human C35/tyrosinase polytope
QNILLSNAPLGPQFPGVRIVVEYAQNILLSNAPLGPQFP

SEQ ID NO: 2134 - protein, 24 aa, Artificial
  synthetic human C35/tyrosinase polytope
GVRIVVEYADYSYLQDSDPDSFQD

SEQ ID NO: 2135 - protein, 39 aa, Artificial
  synthetic human C35/tyrosinase polytope
DYSYLQDSDPDSFQDGVRIVVEYADYSYLQDSDPDSFQD

SEQ ID NO: 2136 - protein, 18 aa, Artificial
  synthetic human C35/Melan-A polytope
GVRIVVEYAILTVILGVL

SEQ ID NO: 2137 - protein, 27 aa, Artificial
  synthetic human C35/Melan-A polytope
ILTVILGVLGVRIVVEYAILTVILGVL

SEQ ID NO: 2138 - protein, 18 aa, Artificial
  synthetic human C35/gp100 polytope
GVRIVVEYAKTWGQYWQV

SEQ ID NO: 2139 - protein, 27 aa, Artificial
  synthetic human C35/gp100 polytope
KTWGQYWQVGVRIVVEYAKTWGQYWQV

SEQ ID NO: 2140 - protein, 18 aa, Artificial
  synthetic human C35/gp100 polytope
GVRIVVEYAITDQVPFSV

SEQ ID NO: 2141 - protein, 27 aa, Artificial
  synthetic human C35/gp100 polytope
ITDQVPFSVGVRIVVEYAITDQVPFSV

SEQ ID NO: 2142 - protein, 4 aa, Artificial
  synthetic human C35 peptide
  misc_feature: X represents any aliphatic amino acid
  misc_feature (2)..(3): Xaa can be any naturally occurring amino acid
CXXL

SEQ ID NO: 2143 - protein, 12 aa, Mus musculus
AFLGYKAGMTHI

SEQ ID NO: 2144 - DNA, 36 bp, Artificial Sequence
  Mus musculus
gcctttctgggttacaaggctggcatgacccacatc

SEQ ID NO: 2145 - protein, 12 aa, Artificial Sequence
  T54I substitution
AFLGYKAGMIHI

SEQ ID NO: 2146 - DNA, 725 bp, Homo sapiens
gcccgagcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctctatccccttcccagggtaagtgcccacgaaagcccagtccactcttcgcctcggtaatacctgtctgatgccacagattttatttattctcccctaacccagggcaatgtcagctatgggcagtaaagtggcgctac

The invention claimed is:

1. An isolated antibody or antigen binding fragment thereof comprising a heavy chain variable domain and a light chain variable domain, wherein said heavy chain variable domain comprises the same three CDRs encoded by a polynucleotide having the sequence of SEQ ID NO: 149; and wherein said light chain variable domain comprises the same three CDRs encoded by a polynucleotide having the sequence of SEQ ID NO: 148, and wherein the antibody or antigen binding fragment thereof specifically binds C35.

2. The antibody or antigen binding fragment thereof according to claim 1, wherein the polynucleotides encoding the heavy chain variable domain CDRs of SEQ ID NO: 149 comprise:

(a) nucleotides 145 to 162 of SEQ ID NO:149;

(b) nucleotides 205 to 252 of SEQ ID NO:149; and (c) nucleotides 349 to 369 of SEQ ID NO:149.

3. The antibody or antigen binding fragment thereof according to claim 1, wherein the polynucleotides encoding the light chain variable domain CDRs of SEQ ID NO; 148 comprise:

(a) nucleotides 136 to 165 of SEQ ID NO:148;

(b) nucleotides 211 to 231 of SEQ ID NO:148; and (c) nucleotides 328 to 354 of SEQ ID NO:148.

4. The antibody or antigen binding fragment thereof according to claim 1, wherein the polynucleotides encoding the heavy chain variable domain CDRs of SEQ ID NO: 149 and the light chain variable domain CDRs of SEQ ID NO: 148 comprise:

(a) nucleotides 145 to 162 of SEQ ID NO:149;

(b) nucleotides 205 to 252 of SEQ ID NO:149;

(c) nucleotides 349 to 369 of SEQ ID NO:149;

(d) nucleotides 136 to 165 of SEQ ID NO:148;

(e) nucleotides 211 to 231 of SEQ ID NO:148; and (f) nucleotides 328 to 354 of SEQ ID NO:148.

5. The antibody or antigen binding fragment according to claims 1, wherein said heavy chain variable domain is encoded by a polynucleotide comprising the sequence of SEQ ID NO: 149.

6. The antibody or antigen binding fragment thereof according to claim 1, wherein said light chain variable domain is encoded by a polynucleotide comprising the sequence of SEQ ID NO: 148.

7. The antibody or antigen binding fragment thereof according to claim 1, wherein said antibody is a full antibody.

8. The antibody or antigen binding fragment thereof according to claim 1, wherein said antigen binding fragment is selected from the group consisting of: a Fab fragment, a F(ab')2 fragment, and a scFv fragment.

9. The antibody or antigen binding fragment thereof according to claim 1, wherein said antibody or antigen binding fragment is chimeric.

10. The antibody or antigen binding fragment thereof of claim 1, wherein said antibody or antigen binding fragment is humanized.

11. A composition comprising the antibody or antigen binding fragment thereof according to claim 1.

12. The composition according to claim 11, wherein said composition further comprises a therapeutic agent.

13. The composition according to claim 12, wherein said therapeutic agent is selected from the group consisting of: an anti-tumor drug, a cytotoxin, and a radioactive agent.

14. The composition according to claim 13, wherein said therapeutic agent is a cytotoxin.

15. The composition according to claim 14, wherein said cytotoxin is selected from the group consisting of: taxol, ricin, doxorubicin, cytochalasin B, gramicidin D, ethidium bromide, etoposide, tenoposide, colchicin, dihydroxy anthracin dione, 1 dehydrotestosterone, and glucocorticoid.

16. The composition according to claim 12, wherein said therapeutic agent is conjugated to or complexed with said antibody or antigen binding fragment thereof.

17. A diagnostic kit for detecting the presence of C35 in a sample, said kit comprising:

(a) the antibody or antigen binding fragment thereof according to claim 1; and (b) a conjugate comprising a specific binding partner for the C35 specific antibody and a label capable of producing a detectable signal.

18. The antibody or antigen binding fragment thereof according to claim 1, further comprising a human immunoglobulin heavy chain constant region or fragment thereof.

19. The antibody or antigen binding fragment thereof according to claim 18, wherein said heavy chain constant region is human IgG.

20. The antibody or antigen binding fragment thereof according to claim 1, further comprising a human immunoglobulin light chain constant region.

21. The antibody or antigen binding fragment thereof according to claim 20, wherein said light chain constant region is human kappa.

* * * * *